(12) United States Patent
Oswald et al.

(10) Patent No.: US 8,277,798 B2
(45) Date of Patent: Oct. 2, 2012

(54) USE OF CELLS CONTAINING A SPECIFIC DNA MOLECULE AS CYTOPATHIC AGENTS TO INHIBIT THE PROLIFERATION OF CELLS

(75) Inventors: Eric Oswald, Toulouse (FR); Jörg Hacker, Gerbrunn (DE); Jean Philippe Nougayrede, Toulouse (FR); Ulrich Dobrindt, Würzburg (DE); Frédéric Taieb, Toulouse (FR); Fabrice Pierre, Cugnaux (FR)

(73) Assignees: Institut National de la Recherche Agronomique, Paris (FR); Bayerische Julius-Maximilians-Universitat Wurzburg, Wurzburg (DE)

( * ) Notice: Subject to any disclaimer, the term of this patent is extended or adjusted under 35 U.S.C. 154(b) by 547 days.

(21) Appl. No.: 12/300,169

(22) PCT Filed: May 10, 2007

(86) PCT No.: PCT/EP2007/054540
§ 371 (c)(1),
(2), (4) Date: Apr. 7, 2009

(87) PCT Pub. No.: WO2007/128838
PCT Pub. Date: Nov. 15, 2007

(65) Prior Publication Data
US 2009/0238804 A1    Sep. 24, 2009

(51) Int. Cl.
*A01N 63/00* (2006.01)
*A01N 65/00* (2009.01)
(52) U.S. Cl. ..................... 424/93.4; 424/93.1
(58) Field of Classification Search .......... None
See application file for complete search history.

(56) References Cited

U.S. PATENT DOCUMENTS

| 8,062,644 B2* | 11/2011 | Pizza et al. .............. 424/241.1 |
| 2003/0148324 A1* | 8/2003 | Bingen et al. ................. 435/6 |
| 2004/0067223 A1 | 4/2004 | Jacob et al. |
| 2005/0208033 A1 | 9/2005 | Luquet et al. |
| 2007/0092954 A1* | 4/2007 | Arslanian et al. ............. 435/117 |
| 2007/0281343 A9* | 12/2007 | Arslanian ..................... 435/117 |
| 2012/0058146 A1* | 3/2012 | Moriel et al. .............. 424/257.1 |

FOREIGN PATENT DOCUMENTS

| DE | 10209958 | 9/2003 |
| EP | 0564121 | 10/1993 |
| WO | WO 01/66572 A2 * | 7/2001 |
| WO | 03045405 | 6/2003 |
| WO | 2005120560 | 12/2005 |

OTHER PUBLICATIONS

Bauer et al, Systematic and Applied Microbiology, 2008, 31:50-61.*
Taieb et al, Cellular Mircobiology, 2006, 8/12:1910-1921.*
Oswald et al, Current Opinion in Microbiology, 2005, 8:83-91.*
Cuevas-Ramos et al, PNAS, USA, Jun. 22, 2010, 107/25:11537-11542.*
Forbes, Nature Reviews, Nov. 2010, 10:785-794.*
Siemann, In: Rodent Tumor Models in Expt'al Cancer Therapy, Ed: Kallman, 1987, pp. 12-15.*
Chen Swaine L et al., "Identification of genes subject to positive selection in uropathogenic strains of *Escherichia coli*: a compariative genomics approach", Proceedings of the National Academy of Sciences of the United States of America, Apr. 11, 2006, vol. 103, No. 15, pp. 5977-5982, XP002423940.
Grozdanov Lubomir et al., "Analysis of the genome structure of the nonpathogenic probiotic *Escherichia coli* strain Nissle 1917", Jurnal of Bacteriology Aug. 2004, vol. 186, No. 16, Aug. 2004, pp. 5432-5441, XP002423941.
Nougayrede Jean-Philippe et al., "*Escherichia coli* induces DNA double-strand breaks in eukaryotic cells", Science Aug. 11, 2006, vol. 313, No. 5788, Aug. 11, 2006, pp. 848-851, XP002423942.
International search report in corresponding PCT/EP2007/054540.
European search report in corresponding EP 06290742.

* cited by examiner

*Primary Examiner* — Nita M Minnifield
(74) *Attorney, Agent, or Firm* — Young & Thompson

(57) ABSTRACT

The present invention relates to the use of cells containing in their genome a specific DNA molecule, as cytopathic agents able to inhibit the proliferation of cells, when these proliferative cells are contacted with the cells containing the above-mentioned DNA molecule.

24 Claims, 10 Drawing Sheets

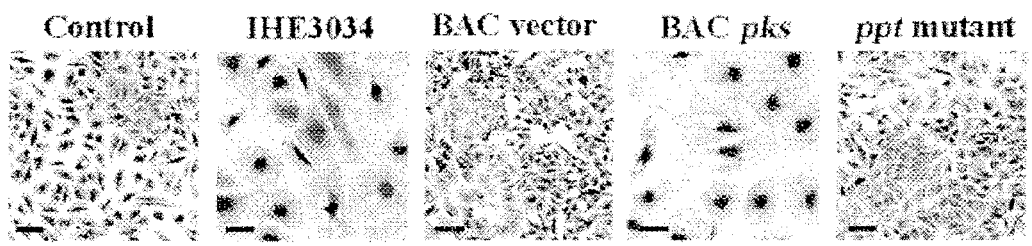
Figure 5
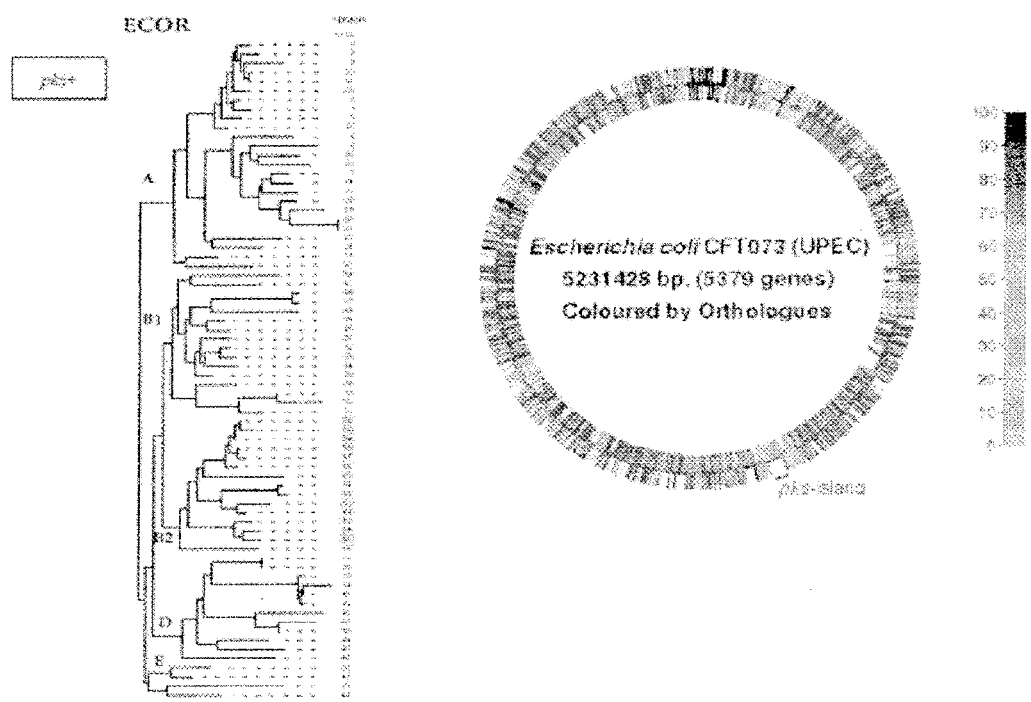
Figure 6A
Figure 6B

USE OF CELLS CONTAINING A SPECIFIC DNA MOLECULE AS CYTOPATHIC AGENTS TO INHIBIT THE PROLIFERATION OF CELLS

The present invention relates to the use of cells containing in their genome a specific DNA molecule, as cytopathic agents able to inhibit the proliferation of cells, when these proliferative cells are contacted with said cells containing the above-mentioned DNA molecule.

Drugs currently used for the treatment of cancer are not efficient enough to eradicate the tumor and often have a strong toxicity towards non tumoral cells. New drugs able to target the tumor and/or to circumvent the problems of drug resistance of tumor cells are under investigation. Among cancers, colon cancer has a high incidence and mortality, and is associated with a poor 5-years survival rate, particularly in Europe and United States.

Recent studies relate the use of lactic bacteria for the treatment or the prevention of cancer (US2005108033 and US2004120963). The mechanism of action involved is not understood, but the protection conferred by lactic bacteria could come from a decrease in the production of carcinogens by the intestinal microflora and/or from the elimination of these carcinogens by the lactic bacteria.

Concerning antibiotics and antifungals, many problems of resistance of the bacteria and fungi responsible of infections decrease the efficiency of currently used drugs. New classes of drugs are thus needed.

Currently used anti-inflammatory drugs are very efficient, but have toxic side effects, particularly upon long-term use, which constitutes a major problem for patients suffering from chronic inflammatory diseases.

The probiotic Nissle 1917, also known as DSM6601, is an *Escherichia coli* strain commercialized in Germany as Mutaflor® by Ardeypharm. Mutaflor® is indicated for the treatment of ulcerative colitis in the phase of remission.

The German patent DE10209958 relates to the use of DSM6601 strain as antiphlogistic agent for treating inflammatory skin diseases and rheumatic diseases.

The German patent DE10126284 relates to the use of DSM6601 *E. coli* strain for the prevention and the treatment of diseases linked to entero-invasive bacteria or other microorganisms such as *Salmonella, Listeria, Shigella, Yersinia* and invasive *E. coli*.

The international application WO 99/26642 relates to the use of the DSM6601 strain to produce drugs for the prevention and the treatment of microbially-caused diarrhea involving pathogenic fungi in veterinary medicine.

*Escherichia coli* is the most common cause of infections by Gram-negative bacilli. It is a frequent etiology of community-acquired urinary tract infections in women and of nosocomial infections among hospitalized patients (1). The versatility of this pathogen arises from production of a diverse array of virulence factors (2). Pathogenic bacteria have evolved means of manipulating basic host cell functions to overcome defense systems and ensure their survival (3). There is a growing number of newly characterized bacterial virulence factors (called cyclomodulins) that can target the host cell cycle and influence whether an infected cell will grow and divide, or die (4). These cyclomodulins may be toxins, effectors, polyketides or polyketide-peptide hybrids.

Non-ribosomal peptides are linear, cyclic or branched peptides often modified by acylation, glycosylation, epimerization, heterocyclization or N-methylation of the amide nitrogen and are produced by the NRPS (NonRibosomal Peptide synthases). Many nonribosomal peptides are used as drugs (e.g. cyclosporine A, bleomycins, etc.).

Polyketides are very useful active compounds produced by PKS (PolyKetide Synthases) enzymes, particularly in bacteria. Polyketides have been broadly used clinically as antibiotics (e.g. Eythromycin A), anti-fungals (Amphoterin B), anti-tumorals (Doxorubincin), etc.

Both NRPS and PKS enzymes have a modular structure and each module is a functional building block. The resultant product may be deduced from the order and number of the modules in the enzyme.

Natural polyketide-peptide hybrids are produced by NRPS-PKS systems. The synthesis of polyketides and polyketide-peptide hybrids by chemistry is very complex and these compounds are usually produced by molecular biology.

An interest of using polyketide-peptide hybrids as drugs is that they are usually less immunogenic than proteins.

The main goal of the present invention is to provide native or transformed cells containing in their genome a specific DNA molecule conferring to said cells the property of being cytopathic agents able to inhibit the proliferation of cells, when these proliferative cells are contacted with said cells containing the above-mentioned DNA molecule.

A further object of this invention is to provide pharmaceutical compositions useful for the prevention or the treatment of a hyperproliferative cancerous or non-cancerous disorder in a mammal, including man.

Another object of the invention is to provide isolated DNA molecules, vectors containing said DNA molecules, host cells transformed with said vectors and pharmaceutical compositions comprising said host cells.

The present invention relates to the use of cells containing in their genome a DNA molecule comprising:

- optionally the nucleotide sequence SEQ ID NO: 1 (ORF 1) coding for the protein of sequence SEQ ID NO: 2, or a sequence derived from SEQ ID NO: 1, and coding for the protein of sequence SEQ ID NO: 1, or for a derived protein having a P4-like bacteriophage integrase activity, and
- optionally the nucleotide sequence SEQ ID NO: 3 (ORF 2) coding for the protein of sequence SEQ ID NO: 4, or a sequence derived from SEQ ID NO: 3, and coding for the protein of sequence SEQ ID NO: 4, and
- the nucleotide sequence SEQ ID NO: 5 (ORF 3) coding for the protein of sequence SEQ ID NO: 6, or the nucleotide sequence SEQ ID NO: 7 (ORF 3a) coding for the protein of sequence SEQ ID NO: 8, or the nucleotide sequence SEQ ID NO: 9 (ORF 3b) coding for the protein of sequence SEQ ID NO: 10, or a sequence derived from SEQ ID NO: 5, 7, or 9, and coding for the protein of sequence SEQ ID NO: 6, 8, or 10, or for a derived protein having a thioesterase activity, and
- the nucleotide sequence SEQ ID NO: 11 (ORF 4) coding for the protein of sequence SEQ ID NO: 12, or the nucleotide sequence SEQ ID NO: 13 (ORF 4a) coding for the protein of sequence SEQ ID NO: 14, or the nucleotide sequence SEQ ID NO: 15 (ORF 4b) coding for the protein of sequence SEQ ID NO: 16, or the nucleotide sequence SEQ ID NO: 17 (ORF 4c) coding for the protein of sequence SEQ ID NO: 18, or a sequence derived from SEQ ID NO: 11, 13, 15, or 17, and coding for the protein of sequence SEQ ID NO: 12, 14, 16, or 18, respectively, or for a derived protein having a β lactamase activity, and
- the nucleotide sequence SEQ ID NO: 19 (ORF 5) coding for the protein of sequence SEQ ID NO: 20, or the nucleotide sequence SEQ ID NO: 21 (ORF 5a) coding for the protein of sequence SEQ ID NO: 22, or the nucleotide sequence SEQ ID NO: 23 (ORF 5b) coding for the protein of sequence SEQ ID NO: 24, or the nucleotide sequence SEQ ID NO: 25 (ORF 5c) coding for the protein of sequence SEQ ID NO: 26, or a sequence derived from SEQ ID NO: 19, 21, 23, or 25, and coding for the protein of sequence SEQ ID NO: 20, 22, 24, or 26, respectively, or for a derived protein having a polyketide synthase activity, and the nucleotide sequence SEQ ID NO: 27 (ORF 6) coding for the protein of sequence SEQ ID NO: 28, or the nucleotide sequence SEQ ID NO: 29 (ORF 6a) coding for the protein of sequence SEQ ID NO: 30, or the nucleotide sequence SEQ ID NO: 31 (ORF 6b) coding for the protein of sequence SEQ ID NO: 32, or the nucleotide sequence SEQ ID NO: 33 (ORF 6c) coding for the protein of sequence SEQ ID NO: 34, or the nucleotide sequence SEQ ID NO: 35 (ORF 6d) coding for the protein of sequence SEQ ID NO: 36, or the nucleotide sequence SEQ ID NO: 37 (ORF 6e) coding for the protein of sequence SEQ ID NO: 38, or a sequence derived from SEQ ID NO: 27, 29, 31, 33, 35, or 37, and coding for the protein of sequence SEQ ID NO: 28, 30, 32, 34, 36, or 38, respectively, or for a derived protein having a non ribosomal peptide synthetase activity, and optionally the nucleotide sequence SEQ ID NO: 39 (ORF 7) coding for the protein of sequence SEQ ID NO: 40, or the nucleotide sequence SEQ ID NO: 41 (ORF 7a) coding for the protein of sequence SEQ ID NO: 42, or the nucleotide sequence SEQ ID NO: 43 (ORF 7b) coding for the protein of sequence SEQ ID NO: 44, or the nucleotide sequence SEQ ID NO: 45 (ORF 7c) coding for the protein of sequence SEQ ID NO: 46, or a sequence derived from SEQ ID NO: 39, 41, 43, or 45, and coding for the protein of sequence SEQ ID NO: 40, 42, 44, or 46, respectively, or for a derived protein having a MATE-like efflux pomp activity, and the nucleotide sequence SEQ ID NO: 47 (ORF 8) coding for the protein of sequence SEQ ID NO: 48, or the nucleotide sequence SEQ ID NO: 49 (ORF 8a) coding for the protein of sequence SEQ ID NO: 50, or the nucleotide sequence SEQ ID NO: 51 (ORF 8b) coding for the protein of sequence SEQ ID NO: 52, or the nucleotide sequence SEQ ID NO: 53 (ORF 8c) coding for the protein of sequence SEQ ID NO: 54, or a sequence derived from SEQ ID NO: 47, 49, 51, or 53, and coding for a protein of sequence SEQ ID NO: 48, 50, 52, or 54, respectively, or for a derived protein having an amidase activity, and the nucleotide sequence SEQ ID NO: 55 (ORF 9) coding for the protein of sequence SEQ ID NO: 56, or the nucleotide sequence SEQ ID NO: 57 (ORF 9a) coding for the protein of sequence SEQ ID NO: 58, or the nucleotide sequence SEQ ID NO: 59 (ORF 9b) coding for the protein of sequence SEQ ID NO: 60, or the nucleotide sequence SEQ ID NO: 61 (ORF 9c) coding for the protein of sequence SEQ ID NO: 62, or a sequence derived from SEQ ID NO: 55, 57, 59, or 61, and coding for the protein of sequence SEQ ID NO: 56, 58, 60, or 62, respectively, or for a derived protein having a non ribosomal peptide synthetase and polyketide synthase activity, and the nucleotide sequence SEQ ID NO: 63 (ORF 10) coding for the protein of sequence SEQ ID NO: 64, or the nucleotide sequence SEQ ID NO: 65 (ORF 10a) coding for the protein of sequence SEQ ID NO: 66, or the nucleotide sequence SEQ ID NO: 67 (ORF 10b) coding for the protein of sequence SEQ ID NO: 68, or the nucleotide sequence SEQ ID NO: 69 (ORF 10c) coding for the protein of sequence SEQ ID NO: 70, or a sequence derived from SEQ ID NO: 63, 65, 67, or 69, and coding for the protein of sequence SEQ ID NO: 64, 66, 68, or 70, respectively, or for a derived protein having a non ribosomal peptide synthetase activity, and the nucleotide sequence SEQ ID NO: 71 (ORF 11) coding for the protein of sequence SEQ ID NO: 72, or the nucleotide sequence SEQ ID NO: 73 (ORF 11a) coding for the protein of sequence SEQ ID NO: 74, or the nucleotide sequence SEQ ID NO: 75 (ORF 11b) coding for the protein of sequence SEQ ID NO: 76, or the nucleotide sequence SEQ ID NO: 77 (ORF 11c) coding for the protein of sequence SEQ ID NO: 78, or a sequence derived from SEQ ID NO: 71, 73, 75, or 77, and coding for the protein of sequence SEQ ID NO: 72, 74, 76, or 78, respectively, or for a derived protein having a polyketide synthase activity, and the nucleotide sequence SEQ ID NO: 79 (ORF 12) coding for the protein of sequence SEQ ID NO: 80, or the nucleotide sequence SEQ ID NO: 81 (ORF 12a) coding for the protein of sequence SEQ ID NO: 82, or the nucleotide sequence SEQ ID NO: 83 (ORF 12b) coding for the protein of sequence SEQ ID NO: 84, or the nucleotide sequence SEQ ID NO: 85 (ORF 12c) coding for the protein of sequence SEQ ID NO: 86, or a sequence derived from SEQ ID NO: 79, 81, 83, or 85, and coding for the protein of sequence SEQ ID NO: 80, 82, 84, or 86, respectively, or for a derived protein having a non ribosomal peptide synthetase activity, and the nucleotide sequence SEQ ID NO: 87 (ORF 13) coding for the protein of sequence SEQ ID NO: 88, or the nucleotide sequence SEQ ID NO: 89 (ORF 13a) coding for the protein of sequence SEQ ID NO: 90, or the nucleotide sequence SEQ ID NO: 91 (ORF 13b) coding for the protein of sequence SEQ ID NO: 92, or the nucleotide sequence SEQ ID NO: 93 (ORF 13c) coding for the protein of sequence SEQ ID NO: 94, or a sequence derived from SEQ ID NO: 87, 89, 91, or 93, and coding for the protein of sequence SEQ ID NO: 88, 90, 92, or 94, respectively, or for a derived protein having a malonyl-CoA-transacylase activity, and the nucleotide sequence SEQ ID NO: 95 (ORF 14) coding for the protein of sequence SEQ ID NO: 96, or the nucleotide sequence SEQ ID NO: 97 (ORF 14a) coding for the protein of sequence SEQ ID NO: 98, or the nucleotide sequence SEQ ID NO: 99 (ORF 14b) coding for the protein of sequence SEQ ID NO: 100, or the nucleotide sequence SEQ ID NO: 101 (ORF 14c) coding for the protein of sequence SEQ ID NO: 102, or a sequence derived from SEQ ID NO: 95, 97, 99, or 101, and coding for the protein of sequence SEQ ID NO: 96, 98, 100, or 102, respectively, or for a derived protein having an acyl-CoA-dehydrogenase activity, and the nucleotide sequence SEQ ID NO: 103 (ORF 15) coding for the protein of sequence SEQ ID NO: 104, or the nucleotide sequence SEQ ID NO: 105 (ORF 15a) coding for the protein of sequence SEQ ID NO: 106, or the nucleotide sequence SEQ ID NO: 107 (ORF 15b) coding for the protein of sequence SEQ ID NO: 108, or the nucleotide sequence SEQ ID NO: 109 (ORF 15c) coding for the protein of sequence SEQ ID NO: 110, or a sequence derived from SEQ ID NO: 103, 105, 107, or 109, and coding for the protein of sequence SEQ ID NO:

104, 106, 108, or 110, respectively, or for a derived protein having a D-alanyl carrier protein activity, and the nucleotide sequence SEQ ID NO: 111 (ORF 16) coding for the protein of sequence SEQ ID NO: 112, or the nucleotide sequence SEQ ID NO: 113 (ORF 16a) coding for the protein of sequence SEQ ID NO: 114, or the nucleotide sequence SEQ ID NO: 115 (ORF 16b) coding for the protein of sequence SEQ ID NO: 116, or the nucleotide sequence SEQ ID NO: 117 (ORF 16c) coding for the protein of sequence SEQ ID NO: 118, or a sequence derived from SEQ ID NO: 111, 113, 115, or 117, and coding for the protein of sequence SEQ ID NO: 112, 114, 116, or 118, respectively, or for a derived protein having a 3-hydroxyacyl-CoA-dehydrogenase activity, and the nucleotide sequence SEQ ID NO: 119 (ORF 17) coding for the protein of sequence SEQ ID NO: 120, or the nucleotide sequence SEQ ID NO: 121 (ORF 17a) coding for the protein of sequence SEQ ID NO: 122, or the nucleotide sequence SEQ ID NO: 123 (ORF 17b) coding for the protein of sequence SEQ ID NO: 124, or the nucleotide sequence SEQ ID NO: 125 (ORF 17c) coding for the protein of sequence SEQ ID NO: 126, or a sequence derived from SEQ ID NO: 119, 121, 123, or 125, and coding for the protein of sequence SEQ ID NO: 120, 122, 124, or 126, respectively, or for a derived protein having a polyketide synthase activity, and the nucleotide sequence SEQ ID NO: 127 (ORF 18) coding for the protein of sequence SEQ ID NO: 128, or the nucleotide sequence SEQ ID NO: 129 (ORF 18a) coding for the protein of sequence SEQ ID NO: 130, or the nucleotide sequence SEQ ID NO: 131 (ORF 18b) coding for the protein of sequence SEQ ID NO: 132, or the nucleotide sequence SEQ ID NO: 133 (ORF 18c) coding for the protein of sequence SEQ ID NO: 134, or the nucleotide sequence SEQ ID NO: 135 (ORF 18d) coding for the protein of sequence SEQ ID NO: 136, or the nucleotide sequence SEQ ID NO: 137 (ORF 18e) coding for the protein of sequence SEQ ID NO: 138, or a sequence derived from SEQ ID NO: 127, 129, 131, 133, 135, or 137, and coding for the protein of sequence SEQ ID NO: 128, 130, 132, 134, 136, or 138, respectively, or for a derived protein having a non ribosomal peptide synthetase and polyketide synthase activity, and optionally the nucleotide sequence SEQ ID NO: 139 (ORF 19) coding for the protein of sequence SEQ ID NO: 140, or the nucleotide sequence SEQ ID NO: 141 (ORF 19a) coding for the protein of sequence SEQ ID NO: 142, or the nucleotide sequence SEQ ID NO: 143 (ORF 19b) coding for the a protein of sequence SEQ ID NO: 144, or a sequence derived from SEQ ID NO: 139, 141, or 143, and coding for the protein of sequence SEQ ID NO: 140, 142, or 144, respectively, or for a derived protein having a LuxR-like regulator activity, and the nucleotide sequence SEQ ID NO: 145 (ORF 20) coding for the protein of sequence SEQ ID NO: 146, or the nucleotide sequence SEQ ID NO: 147 (ORF 20a) coding for the protein of sequence SEQ ID NO: 148, or the nucleotide sequence SEQ ID NO: 149 (ORF 20b) coding for the protein of sequence SEQ ID NO: 150, or a sequence derived from SEQ ID NO: 145, 147, or 149, and coding for the protein of sequence SEQ ID NO: 146, 148, or 150, respectively, or for a derived protein having a 4-phosphopantetheinyl transferase activity, and optionally the nucleotide sequence SEQ ID NO: 151 (ORF 21) coding for the protein of sequence SEQ ID NO: 152, or the nucleotide sequence SEQ ID NO: 153 (ORF 21a) coding for the protein of sequence SEQ ID NO: 154, or the nucleotide sequence SEQ ID NO: 155 (ORF 21b) coding for the protein of sequence SEQ ID NO: 156, or a sequence derived from SEQ ID NO: 151, 153, or 155, and coding for the protein of sequence SEQ ID NO: 152, 154, or 156, respectively, or for a derived protein having a transposase subunit A activity, and optionally the nucleotide sequence SEQ ID NO: 157 (ORF 22) coding for the protein of sequence SEQ ID NO: 158, or the nucleotide sequence SEQ ID NO: 159 (ORF 22a) coding for the protein of sequence SEQ ID NO: 160, or the nucleotide sequence SEQ ID NO: 161 (ORF 22b) coding for the protein of sequence SEQ ID NO: 162, or a sequence derived from SEQ ID NO: 157, 159, or 161, and coding for the protein of sequence SEQ ID NO: 158, 160, or 162, respectively, or for a derived protein having a transposase subunit B activity, and optionally the nucleotide sequence SEQ ID NO: 163 (ORF 23) coding for the protein of sequence SEQ ID NO: 164, or the nucleotide sequence SEQ ID NO: 165 (ORF 23a) coding for the protein of sequence SEQ ID NO: 166, or the nucleotide sequence SEQ ID NO: 167 (ORF 23b) coding for the protein of sequence SEQ ID NO: 168, or a sequence derived from SEQ ID NO: 163, 165, or 167, and coding for the protein of sequence SEQ ID NO: 164, 166, or 168, respectively, or for a derived protein having a transposase activity, as cytopathic agents able to inhibit the proliferation of cells, when these proliferative cells are contacted with said cells containing the above-mentioned DNA molecule, the use of the *E. coli* strain Nissle 1917 deposited at the DSM under the number 6601 for the preparation of drugs for the treatment of ulcerative colitis in the phase of remission, or chronic constipation, being excluded.

The expression "containing in their genome a DNA molecule" means that said DNA molecule is present in the cell, either integrated in the chromosome, either in a replicon.

A "replicon" refers to any genetic element capable of replication under its own control. A replicon is for example a plasmid, a cosmid, or a bacterial artificial chromosome (BAC).

The expression "cytopathic agents" refers to agents that induce an irreversible inhibition of cell proliferation.

The inhibition of cell proliferation may be assessed by cell proliferation tests, such as classical tests based on BrdU incorporation during DNA synthesis, or other tests such as analysis of the DNA content of a cell population by Fluorescence Activated Cell Sorter (FACS), or by incorporation of a radioactively labelled DNA precursor, or by scoring the mitotic index of a cell population, or by scoring the increase in the total mass of a cell population (growth curve), or the increase in the rate of protein synthesis.

The expression "a derived protein" relates to a protein homologous to the proteins of the above-mentioned sequences and that has the same activity. A homologous protein share at least 75%, particularly at least 90% and more particularly at least 95% of identity with the above-mentioned proteins.

A nucleotide sequence as defined above is a DNA, preferentially a double strand DNA. The term ORF (Open Reading Frame) refers to a nucleotide sequence coding for a protein.

A nucleotide sequence or a DNA coding for a protein is a nucleotide sequence that is transcripted in mRNA, the mRNA being then translated in the corresponding protein. A coding sequence for a protein may include a start codon (methionine or valine) and a stop codon.

The invention also relates to homologous nucleotide sequences, which have at least 75% of identity with the above described nucleotide sequences, particularly at least 90% and more particularly at least 95% of identity, and which encode proteins that have the same activity.

The homologous nucleotide sequences particularly encode the above described proteins due to the degeneracy of the genetic code By "protein having a P4-like bacteriophage integrase activity", one means a protein that catalyses the integration of exogenous DNA into genomic DNA molecule, by forming a transient DNA-protein link. The gene coding for this integrase is not required for the cytopathic effect.

By "protein having a thioesterase activity", one means a protein that catalyses ester bonds (Arch Microbiol. 1998 May; 169(5):404-10).

By "protein having a β lactamase activity", one means a protein that catalyses the hydrolysis of beta-lactam compounds (J Mol Biol. 1991 Jul. 20; 220(2):435-55).

By "protein having a polyketide synthase activity", one means a modular protein that catalyzes polyketide synthesis (Science. 2004 Mar. 19; 303(5665):1805-10).

By "protein having a non-ribosomal peptide synthetase activity", one means a modular protein that catalyzes non-ribosomal peptide synthesis (Science. 2004 Mar. 19; 303 (5665):1805-10).

By "protein having a MATE-like efflux pomp activity", one means a transmembrane protein of the MATE family that functions as an efflux transporter (Mol Microbiol. 1999 January; 31(1):394-5).

Brown et al. (1999, Mol. Microbiol. 31, 393-395) defined a fifth family, called the multidrug and toxic compound extrusion (MATE) family of transporters. The MATE family is characterized by the presence of 12 putative transmembrane segments and by the absence of "signature sequences" specific to the other multidrug transporter superfamilies. MATE proteins are believed to function as proton-dependent efflux transporters, based on the genetic characterization of two family members, NorM from *Vibrio parahaemolyticus* and its homolog YdeH from *Escherichia coli*. Expression of these proteins in *E. coli* confers resistance to various antibiotics and antimicrobial agents that is dependent on the maintenance of a proton gradient across the plasma membrane. MATE genes are abundant in bacteria and plants—the *Arabidopsis* genome contains at least 54 MATE family members—but have not been found in mammals. Aside from NorM and YdeH, very little functional information is available on these proteins.

By "protein having an amidase activity", one means a protein that hydrolyses amides (Biochim Biophys Acta. 1991 Feb. 16; 1088(2):225-33).

By "protein having a malonyl-CoA-transacylase activity", one means a protein that catalyzes the transfer of the malonyl moiety from malonyl-CoA onto an acyl carrier protein (J Biol Chem. 1995 Jun. 2; 270(22):12961-4).

By "protein having an acyl-CoA-dehydrogenase activity", one means a protein that catalyzes the dehydrogenation of acyl-CoA thioesters (J Biol Chem. 1989 Sep. 25; 264(27): 16321-31).

By "protein having a D-alanyl carrier protein activity", one means a protein that binds alanyl groups (J Biol Chem. 1995 Jun. 30; 270(26):15598-606).

By "protein having a 3-hydroxyacyl-CoA-dehydrogenase activity", one means a protein that catalyzes the dehydrogenation of hydroxyacyl-CoA thioesters (J Biol Chem. 1989 Sep. 25; 264(27):16321-31).

By "protein having a LuxR-like regulator activity", one means a protein of the LuxR family, that activates translation (J Bacteriol. 1994 January; 176(2):269-75).

By "protein having a 4-phosphopantetheinyl transferase activity", one means a protein that transfer the 4'-phosphopantetheine moiety from coenzyme-A to the pp-binding domain of non-ribosomal peptide synthases and polyketide synthases (Chem Biol. 1996 November; 3(11):923-36).

By "protein having transposase activity", one means a protein involved in site-specific DNA recombination (J Bacteriol. 1986 February; 165(2):341-7).

The invention also relates to the use of cells as defined above, characterized in that:
  SEQ ID NO: 145, 147, or 149, and optionally SEQ ID NO: 1, and/or SEQ ID NO: 139, 141, or 143, and/or SEQ ID NO: 151, 153, or 155, and/or SEQ ID NO: 157, 159, or 161, and/or SEQ ID NO: 163, 165, and 167 are located in the 5'→3' sense on the 5'-3' strand,
  SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, SEQ ID NO: 127, 129, 131, 133, 135, or 137, and optionally SEQ ID NO: 3, and/or SEQ ID NO: 39, 41, 43, or 45, are located in the 5'→3' sense on the 3'-5' strand complementary to the preceding strand.

The expression "a strand complementary to the preceding strand" means that said strand is the complementary oligonucleotide that can form hydrogen bonds with the sense nucleotide of the preceding strand, by Watson-Crick interactions. The complementary strands of a double strand DNA are antiparallel.

Because of its asymmetric shape, a DNA strand has a discernible orientation: a DNA strand is read in the direction 5' to 3', the term "5'" referring to the phosphate extremity and the term "3'" to the —OH extremity of the DNA strand.

RNA is synthesized in the direction 5'→3' by the RNA polymerases which thus read the DNA template in the direction 3'→5'.

In an embodiment, the invention more particularly relates to the use as defined above of cells containing in their genome a DNA molecule comprising:
  SEQ ID NO: 1, SEQ ID NO: 139, 141, or 143, SEQ ID NO: 145, 147, or 149, SEQ ID NO: 151, 153, or 155, SEQ ID NO: 157, 159, or 161, and SEQ ID NO: 163, 165, and 167, located in the 5'→3' sense on the 5'-3' strand,
  SEQ ID NO: 3, SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, SEQ ID NO: 127, 129, 131, 133, 135, or 137, located in the 5'→3' sense on the 3'-5' strand complementary to the preceding strand,
and its complementary sequence,
said DNA molecule coding for the protein SEQ ID NO: 2, the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 130, 142, or 144, the protein SEQ ID NO: 146, 148, or 150, the protein SEQ ID NO: 152, 154, or 156, the protein SEQ ID NO: 158, 160, or 162, and the protein SEQ ID NO: 164, 166, and 168, such as the DNA molecule containing the nucleotide sequence SEQ ID NO: 170 and its complementary sequence.

In a preferred embodiment, the invention more particularly concerns the use as defined above of cells containing in their genome a DNA molecule comprising:

SEQ ID NO: 145, 147, or 149, and SEQ ID NO: 139, 141, or 143, located in the 5'→3' sense on the 5'-3' strand, SEQ ID NO: 3, 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'→3' sense on the 3'-5' strand complementary to the preceding strand, and its complementary sequence, said DNA molecule coding for the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 130, 142, or 144, and the protein SEQ ID NO: 146, 148, or 150.

In another preferred embodiment, the invention more particularly concerns the use as defined above of cells containing in their genome a DNA molecule comprising:

SEQ ID NO: 145, 147, or 149, located in the 5'→3' sense on the 5'-3' strand,

SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'→3' sense on the 3'-5' strand complementary to the preceding strand, and its complementary sequence, said DNA molecule coding for the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, and the protein SEQ ID NO: 146, 148, or 150, such as the DNA molecule containing the nucleotide sequence SEQ ID NO: 169 and its complementary sequence.

The invention further relates to the above-mentioned use of cells which at their native state contain in their genome a DNA molecule as defined above.

The expression "in their native state" means that said DNA molecule is naturally present in the cells, by opposition to cells that do not naturally contain said DNA molecule but have been transformed with said DNA upon human intervention.

The invention relates more particularly to the use as mentioned above, of cells as defined above chosen among bacterial cells or fungal cells.

The invention concerns more particularly the use as mentioned above, of cells as defined above chosen among:
*Escherichia* bacteria, such as *E. coli*,
*Salmonella* bacteria, such as *S. typhimurium* and *S. typhi*,
*Lactobacilli* bacteria,
*Streptomyces* bacteria,
yeast cells.

The invention also relates to the above-mentioned use of cells, corresponding to the *E. coli* strain Nissle 1917 deposited at the DSM under the number 6601, said strain containing the nucleotide sequence SEQ ID NO: 170 and its complementary sequence.

The present invention also relates to the above-mentioned use of cells containing in their genome a DNA molecule as defined above, said cells being transformed with said DNA molecule.

The cells are transformed with said DNA molecule by methods well known in the art, such as physical transformation, particularly electroporation, or chemical transformation, such as polyethylene glycol treatment or precipitation with calcium phosphate.

The invention further relates to the above-mentioned use of cells transformed with said DNA molecule as defined above, chosen among chosen among bacterial cells or fungal cells.

The invention concerns more particularly the use as mentioned above, of cells transformed with said DNA molecule as defined above chosen among:
*Escherichia* bacteria, such as *E. coli*,
*Salmonella* bacteria, such as *S. typhimurium* and *S. typhi*,
*Lactobacilli* bacteria,
*Streptomyces* bacteria,
yeast cells.

The invention relates to the above-mentioned use of cells as defined above, as cytopathic agents able to inhibit the proliferation of cells chosen among cancerous or non-cancerous proliferative cells.

The invention also relates to the use of cells as defined above, for the preparation of a pharmaceutical composition useful for the prevention or the treatment of a hyperproliferative cancerous or non-cancerous disorder in a mammal, including man.

The invention relates more particularly to the use of cells as defined above, for the preparation of a pharmaceutical composition useful for the prevention or the treatment of cancers such as brain, lung, squamous cell, bladder, gastric, pancreatic, breast, head, neck, renal, kidney, ovarian, prostate, colorectal, oesophageal, gynecological or thyroid cancer.

The invention also relates more particularly to the use of cells as defined above, for the preparation of a pharmaceutical composition useful for the prevention or the treatment of a non-cancerous hyperproliferative disorder such as benign hyperplasia of the skin (psoriasis) or prostate (benign prostatic hypertrophy), kidney disease (proliferative glomerulonephritis and diabetes-induced renal disease).

The invention also more particularly concerns the use of cells as defined above, for the preparation of a pharmaceutical composition useful for the prevention or the treatment of inflammatory diseases, such as inflammatory skin diseases and dermatitis.

The invention also concerns an isolated DNA molecule consisting of or comprising:

optionally the nucleotide sequence SEQ ID NO: 1 (ORF 1) coding for the protein of sequence SEQ ID NO: 2, or a sequence derived from SEQ ID NO: 1, and coding for the protein of sequence SEQ ID NO: 1, or for a derived protein having a P4-like bacteriophage integrase activity, and optionally the nucleotide sequence SEQ ID NO: 3 (ORF 2) coding for the protein of sequence SEQ ID NO: 4, or a sequence derived from SEQ ID NO: 3, and coding for the protein of sequence SEQ ID NO: 4, and the nucleotide sequence SEQ ID NO: 5 (ORF 3) coding for the protein of sequence SEQ ID NO: 6, or the nucleotide sequence SEQ ID NO: 7 (ORF 3a) coding for the protein of sequence SEQ ID NO: 8, or the nucleotide sequence SEQ ID NO: 9 (ORF 3b) coding for the protein of sequence SEQ ID NO: 10, or a sequence derived from SEQ ID NO: 5, 7, or 9, and coding for the protein of sequence SEQ ID NO: 6, 8, or 10, or for a derived protein having a thioesterase activity, and the nucleotide sequence SEQ ID NO: 11 (ORF 4) coding for the protein of sequence SEQ ID NO: 12, or the nucleotide sequence SEQ ID NO: 13 (ORF 4a) coding for the protein of sequence SEQ ID NO: 14, or the nucleotide sequence SEQ ID NO: 15 (ORF 4b) coding for the protein of sequence SEQ ID NO: 16, or the nucleotide sequence SEQ ID NO: 17 (ORF 4c) coding for the protein of sequence SEQ ID NO: 18, or a sequence derived from SEQ ID NO: 11, 13, 15, or 17, and coding for the protein of sequence SEQ ID NO: 12, 14, 16, or 18, respectively, or for a derived protein having a β lactamase activity, and the nucleotide sequence SEQ ID NO: 19 (ORF 5) coding for the protein of sequence SEQ ID NO: 20, or the nucleotide sequence SEQ ID NO: 21 (ORF 5a) coding for the protein of sequence SEQ ID NO: 22, or the nucleotide sequence SEQ ID NO: 23 (ORF 5b) coding for the protein of sequence SEQ ID NO: 24, or the nucleotide sequence SEQ ID NO: 25 (ORF 5c) coding for the protein of sequence SEQ ID NO: 26, or a sequence derived from SEQ ID NO: 19, 21, 23, or 25, and coding for the protein of sequence SEQ ID NO: 20, 22, 24, or 26, respectively, or for a derived protein having a polyketide synthase activity, and the nucleotide sequence SEQ ID NO: 27 (ORF 6) coding for the protein of sequence SEQ ID NO: 28, or the nucleotide sequence SEQ ID NO: 29 (ORF 6a) coding for the protein of sequence SEQ ID NO: 30, or the nucleotide sequence SEQ ID NO: 31 (ORF 6b) coding for the protein of sequence SEQ ID NO: 32, or the nucleotide sequence SEQ ID NO: 33 (ORF 6c) coding for the protein of sequence SEQ ID NO: 34, or the nucleotide sequence SEQ ID NO: 35 (ORF 6d) coding for the protein of sequence SEQ ID NO: 36, or the nucleotide sequence SEQ ID NO: 37 (ORF 6e) coding for the protein of sequence SEQ ID NO: 38, or a sequence derived from SEQ ID NO: 27, 29, 31, 33, 35, or 37, and coding for the protein of sequence SEQ ID NO: 28, 30, 32, 34, 36, or 38, respectively, or for a derived protein having a non ribosomal peptide synthetase activity, and optionally the nucleotide sequence SEQ ID NO: 39 (ORF 7) coding for the protein of sequence SEQ ID NO: 40, or the nucleotide sequence SEQ ID NO: 41 (ORF 7a) coding for the protein of sequence SEQ ID NO: 42, or the nucleotide sequence SEQ ID NO: 43 (ORF 7b) coding for the protein of sequence SEQ ID NO: 44, or the nucleotide sequence SEQ ID NO: 45 (ORF 7c) coding for the protein of sequence SEQ ID NO: 46, or a sequence derived from SEQ ID NO: 39, 41, 43, or 45, and coding for the protein of sequence SEQ ID NO: 40, 42, 44, or 46, respectively, or for a derived protein having a MATE-like efflux pump activity, and the nucleotide sequence SEQ ID NO: 47 (ORF 8) coding for the protein of sequence SEQ ID NO: 48, or the nucleotide sequence SEQ ID NO: 49 (ORF 8a) coding for the protein of sequence SEQ ID NO: 50, or the nucleotide sequence SEQ ID NO: 51 (ORF 8b) coding for the protein of sequence SEQ ID NO: 52, or the nucleotide sequence SEQ ID NO: 53 (ORF 8c) coding for the protein of sequence SEQ ID NO: 54, or a sequence derived from SEQ ID NO: 47, 49, 51, or 53, and coding for a protein of sequence SEQ ID NO: 48, 50, 52, or 54, respectively, or for a derived protein having an amidase activity, and the nucleotide sequence SEQ ID NO: 55 (ORF 9) coding for the protein of sequence SEQ ID NO: 56, or the nucleotide sequence SEQ ID NO: 57 (ORF 9a) coding for the protein of sequence SEQ ID NO: 58, or the nucleotide sequence SEQ ID NO: 59 (ORF 9b) coding for the protein of sequence SEQ ID NO: 60, or the nucleotide sequence SEQ ID NO: 61 (ORF 9c) coding for the protein of sequence SEQ ID NO: 62, or a sequence derived from SEQ ID NO: 55, 57, 59, or 61, and coding for the protein of sequence SEQ ID NO: 56, 58, 60, or 62, respectively, or for a derived protein having a non ribosomal peptide synthetase and polyketide synthase activity, and the nucleotide sequence SEQ ID NO: 63 (ORF 10) coding for the protein of sequence SEQ ID NO: 64, or the nucleotide sequence SEQ ID NO: 65 (ORF 10a) coding for the protein of sequence SEQ ID NO: 66, or the nucleotide sequence SEQ ID NO: 67 (ORF 10b) coding for the protein of sequence SEQ ID NO: 68, or the nucleotide sequence SEQ ID NO: 69 (ORF 10c) coding for the protein of sequence SEQ ID NO: 70, or a sequence derived from SEQ ID NO: 63, 65, 67, or 69, and coding for the protein of sequence SEQ ID NO: 64, 66, 68, or 70, respectively, or for a derived protein having a non ribosomal peptide synthetase activity, and the nucleotide sequence SEQ ID NO: 71 (ORF 11) coding for the protein of sequence SEQ ID NO: 72, or the nucleotide sequence SEQ ID NO: 73 (ORF 11a) coding for the protein of sequence SEQ ID NO: 74, or the nucleotide sequence SEQ ID NO: 75 (ORF 11b) coding for the protein of sequence SEQ ID NO: 76, or the nucleotide sequence SEQ ID NO: 77 (ORF 11c) coding for the protein of sequence SEQ ID NO: 78, or a sequence derived from SEQ ID NO: 71, 73, 75, or 77, and coding for the protein of sequence SEQ ID NO: 72, 74, 76, or 78, respectively, or for a derived protein having a polyketide synthase activity, and the nucleotide sequence SEQ ID NO: 79 (ORF 12) coding for the protein of sequence SEQ ID NO: 80, or the nucleotide sequence SEQ ID NO: 81 (ORF 12a) coding for the protein of sequence SEQ ID NO: 82, or the nucleotide sequence SEQ ID NO: 83 (ORF 12b) coding for the protein of sequence SEQ ID NO: 84, or the nucleotide sequence SEQ ID NO: 85 (ORF 12c) coding for the protein of sequence SEQ ID NO: 86, or a sequence derived from SEQ ID NO: 79, 81, 83, or 85, and coding for the protein of sequence SEQ ID NO: 80, 82, 84, or 86, respectively, or for a derived protein having a non ribosomal peptide synthetase activity, and the nucleotide sequence SEQ ID NO: 87 (ORF 13) coding for the protein of sequence SEQ ID NO: 88, or the nucleotide sequence SEQ ID NO: 89 (ORF 13a) coding for the protein of sequence SEQ ID NO: 90, or the nucleotide sequence SEQ ID NO: 91 (ORF 13b) coding for the protein of sequence SEQ ID NO: 92, or the nucleotide sequence SEQ ID NO: 93 (ORF 13c) coding for the protein of sequence SEQ ID NO: 94, or a sequence derived from SEQ ID NO: 87, 89, 91, or 93, and coding for the protein of sequence SEQ ID NO: 88, 90, 92, or 94, respectively, or for a derived protein having a malonyl-CoA-transacylase activity, and the nucleotide sequence SEQ ID NO: 95 (ORF 14) coding for the protein of sequence SEQ ID NO: 96, or the nucleotide sequence SEQ ID NO: 97 (ORF 14a) coding for the protein of sequence SEQ ID NO: 98, or the nucleotide sequence SEQ ID NO: 99 (ORF 14b) coding for the protein of sequence SEQ ID NO: 100, or the nucleotide sequence SEQ ID NO: 101 (ORF 14c) coding for the protein of sequence SEQ ID NO: 102, or a sequence derived from SEQ ID NO: 95, 97, 99, or 101, and coding for the protein of sequence SEQ ID NO: 96, 98, 100, or 102, respectively, or for a derived protein having an acyl-CoA-dehydrogenase activity, and the nucleotide sequence SEQ ID NO: 103 (ORF 15) coding for the protein of sequence SEQ ID NO: 104, or the nucleotide sequence SEQ ID NO: 105 (ORF 15a) coding for the protein of sequence SEQ ID NO: 106, or the nucleotide sequence SEQ ID NO: 107 (ORF 15b) coding for the protein of sequence SEQ ID NO: 108, or the nucleotide sequence SEQ ID NO: 109 (ORF 15c) coding for the protein of sequence SEQ ID NO: 110, or a sequence derived from SEQ ID NO: 103, 105, 107, or 109, and coding for the protein of sequence SEQ ID NO: 104, 106, 108, or 110, respectively, or for a derived protein having a D-alanyl carrier protein activity, and the nucleotide sequence SEQ ID NO: 111 (ORF 16) coding for the protein of sequence SEQ ID NO: 112, or the nucleotide sequence SEQ ID NO: 113 (ORF 16a) coding for the protein of sequence SEQ ID NO: 114, or the nucleotide sequence SEQ ID NO: 115 (ORF 16b) coding for the protein of sequence SEQ ID NO: 116, or the nucleotide sequence SEQ ID NO: 117 (ORF 16c) coding for the protein of sequence SEQ ID NO: 118, or a sequence derived from SEQ ID NO: 111, 113, 115, or 117, and coding for the protein of sequence SEQ ID NO: 112, 114, 116, or 118, respectively, or for a derived protein having a 3-hydroxyacyl-CoA-dehydrogenase activity, and the nucleotide sequence SEQ ID NO: 119 (ORF 17) coding for the protein of sequence SEQ ID NO: 120, or the nucleotide sequence SEQ ID NO: 121 (ORF 17a) coding for the protein of sequence SEQ ID NO: 122, or the nucleotide sequence SEQ ID NO: 123 (ORF 17b) coding for the protein of sequence SEQ ID NO: 124, or the nucleotide sequence SEQ ID NO: 125 (ORF 17c) coding for the protein of sequence SEQ ID NO: 126, or a sequence derived from SEQ ID NO: 119, 121, 123, or 125, and coding for the protein of sequence SEQ ID NO: 120, 122, 124, or 126, respectively, or for a derived protein having a polyketide synthase activity, and the nucleotide sequence SEQ ID NO: 127 (ORF 18) coding for the protein of sequence SEQ ID NO: 128, or the nucleotide sequence SEQ ID NO: 129 (ORF 18a) coding for the protein of sequence SEQ ID NO: 130, or the nucleotide sequence SEQ ID NO: 131 (ORF 18b) coding for the protein of sequence SEQ ID NO: 132, or the nucleotide sequence SEQ ID NO: 133 (ORF 18c) coding for the protein of sequence SEQ ID NO: 134, or the nucleotide sequence SEQ ID NO: 135 (ORF 18d) coding for the protein of sequence SEQ ID NO: 136, or the nucleotide sequence SEQ ID NO: 137 (ORF 18e) coding for the protein of sequence SEQ ID NO: 138, or a sequence derived from SEQ ID NO: 127, 129, 131, 133, 135, or 137, and coding for the protein of sequence SEQ ID NO: 128, 130, 132, 134, 136, or 138, respectively, or for a derived protein having a non ribosomal peptide synthetase and polyketide synthase activity, and optionally the nucleotide sequence SEQ ID NO: 139 (ORF 19) coding for the protein of sequence SEQ ID NO: 140, or the nucleotide sequence SEQ ID NO: 141 (ORF 19a) coding for the protein of sequence SEQ ID NO: 142, or the nucleotide sequence SEQ ID NO: 143 (ORF 19b) coding for the a protein of sequence SEQ ID NO: 144, or a sequence derived from SEQ ID NO: 139, 141, or 143, and coding for the protein of sequence SEQ ID NO: 140, 142, or 144, respectively, or for a derived protein having a LuxR-like regulator activity, and the nucleotide sequence SEQ ID NO: 145 (ORF 20) coding for the protein of sequence SEQ ID NO: 146, or the nucleotide sequence SEQ ID NO: 147 (ORF 20a) coding for the protein of sequence SEQ ID NO: 148, or the nucleotide sequence SEQ ID NO: 149 (ORF 20b) coding for the protein of sequence SEQ ID NO: 150, or a sequence derived from SEQ ID NO: 145, 147, or 149, and coding for the protein of sequence SEQ ID NO: 146, 148, or 150, respectively, or for a derived protein having a 4-phosphopantetheinyl transferase activity, and optionally the nucleotide sequence SEQ ID NO: 151 (ORF 21) coding for the protein of sequence SEQ ID NO: 152, or the nucleotide sequence SEQ ID NO: 153 (ORF 21a) coding for the protein of sequence SEQ ID NO: 154, or the nucleotide sequence SEQ ID NO: 155 (ORF 21b) coding for the protein of sequence SEQ ID NO: 156, or a sequence derived from SEQ ID NO: 151, 153, or 155, and coding for the protein of sequence SEQ ID NO: 152, 154, or 156, respectively, or for a derived protein having a transposase subunit A activity, and optionally the nucleotide sequence SEQ ID NO: 157 (ORF 22) coding for the protein of sequence SEQ ID NO: 158, or the nucleotide sequence SEQ ID NO: 159 (ORF 22a) coding for the protein of sequence SEQ ID NO: 160, or the nucleotide sequence SEQ ID NO: 161 (ORF 22b) coding for the protein of sequence SEQ ID NO: 162, or a sequence derived from SEQ ID NO: 157, 159, or 161, and coding for the protein of sequence SEQ ID NO: 158, 160, or 162, respectively, or for a derived protein having a transposase subunit B activity, and optionally the nucleotide sequence SEQ ID NO: 163 (ORF 23) coding for the protein of sequence SEQ ID NO: 164, or the nucleotide sequence SEQ ID NO: 165 (ORF 23a) coding for the protein of sequence SEQ ID NO: 166, or the nucleotide sequence SEQ ID NO: 167 (ORF 23b) coding for the protein of sequence SEQ ID NO: 168, or a sequence derived from SEQ ID NO: 163, 165, or 167, and coding for the protein of sequence SEQ ID NO: 164, 166, or 168, respectively, or for a derived protein having a transposase activity.

According to another embodiment, the present invention relates to an isolated DNA molecule consisting of or comprising:

SEQ ID NO: 1, SEQ ID NO: 139, 141, or 143, SEQ ID NO: 145, 147, or 149, SEQ ID NO: 151, 153, or 155, SEQ ID NO: 157, 159, or 161, and SEQ ID NO: 163, 165, and 167, located in the 5'→3' sense on the 5'-3' strand, SEQ ID NO: 3, SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, SEQ ID NO: 127, 129, 131, 133, 135, or 137, located in the 5'→3' sense on the 3'-5' strand complementary to the preceding strand, and its complementary sequence, said DNA molecule coding for the protein SEQ ID NO: 2, the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 130, 142, or 144, the protein SEQ ID NO: 146, 148, or 150, the protein SEQ ID NO: 152, 154, or 156, the protein SEQ ID NO: 158, 160, or 162, and the protein SEQ ID NO: 164, 166, and 168, such as the DNA molecule consisting of the nucleotide sequence SEQ ID NO: 170 and its complementary sequence.

According to a preferred embodiment, the present invention relates to an isolated DNA molecule consisting of or comprising:

SEQ ID NO: 145, 147, or 149, and SEQ ID NO: 139, 141, or 143, located in the 5'→3' sense on the 5'-3' strand, SEQ ID NO: 3, 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'→3' sense on the 3'-5' strand complementary to the preceding strand, and its complementary sequence, said DNA molecule coding for the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 130, 142, or 144, and the protein SEQ ID NO: 146, 148, or 150.

In another preferred embodiment, the invention more particularly concerns the use as defined above of cells containing in their genome a DNA molecule comprising:

SEQ ID NO: 145, 147, or 149, located in the 5'→3' sense on the 5'-3' strand,

SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'→3' sense on the 3'-5' strand complementary to the preceding strand, and its complementary sequence, said DNA molecule coding for the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, and the protein SEQ ID NO: 146, 148, or 150, such as the DNA molecule consisting of the nucleotide sequence SEQ ID NO: 169 and its complementary sequence.

The invention also relates to a transducible cloning vector, such as phagemid, cosmid, bacterial artificial chromosome (BAC) or yeast artificial chromosome (YAC), containing a DNA molecule as defined above.

A "vector" is a replicon to which another genetic sequence or element may be linked, so as said genetic sequence or element is replicated ate the same time as the replicon.

Various genetic regulatory control elements may be incorporated into vectors, such as promoters, enhancers, translational start signals, polyadenylation signals, terminators, and the like, in order to facilitate the expression of the DNA molecule in a host cell.

The invention further relates to a host cell transformed with a vector as defined above.

The host cell according to the present invention includes prokaryotic host cells, particularly bacterial cells such as *E. coli* or eukaryotic cells.

The host cell is transformed by methods of transformation well known in the art, such as electroporation, polyethylene glycol treatment, precipitation with calcium phosphate.

The invention relates to a host cell as defined above, chosen among bacterial cells or fungal cells.

The invention concerns more particularly host cells as defined above chosen among

*Escherichia* bacteria, such as *E. coli*,
*Salmonella* bacteria, such as *S. typhimurium* and *S. typhi*,
*Lactobacilli* bacteria,
*Streptomyces* bacteria,
yeast cells.

According to another embodiment, the present invention relates to a pharmaceutical composition comprising a host cell as defined above, in association with a physiologically acceptable carrier.

The invention also relates to a pharmaceutical composition as defined above, in a suitable form for its administration orally, topically, rectally, or vaginally.

According to a preferred embodiment of the invention, the cells are lyophilized in the pharmaceutical composition, which is preferentially formulated in capsules for oral administration and in suppository for vaginal or rectal administration.

The pharmaceutical composition is conveniently formulated with an acceptable carrier such as water, buffered saline, ethanol, polyol (for example, glycerol, propylene glycol, liquid polyethylene glycol and the like), glycerinated gelatin, dimethyl sulfoxide (DMSO), oils, detergents, suspending agents or suitable mixtures thereof.

The invention further relates to a pharmaceutical composition as defined above, characterized in that the dosage of cells as defined above is comprised between $10^6$ and $10^{11}$ cells, administered semi-daily, daily, semi-weekly, weekly, semi-monthly, or monthly.

The dosage of cells and length of administration is the minimum amount of pharmaceutical composition that is needed to effectuate the desired effect.

The invention relates to the use of a DNA molecule as defined above, or of fragments thereof, as probes for the screening of cells acting as cytopathic agents.

Morphologic changes induced by live *E. coli* upon interaction with epithelial (HeLa) cells.

Live ExPEC strain IHE3034 or laboratory strain DH10B were added directly onto HeLa cells. A control is shown where no bacteria were added onto HeLa cells. After 4 h co-culture, bacteria were washed and cells were incubated further for 72 h with gentamicin (upper panel). In other experiments, bacterial supernatants of IHE3034 grown in interaction medium were assayed for cytopathic activity (lower panel). Bacteria were also cultivated in an insert, separated by a 0.2 μm permeable membrane 1 mm above the cells ("insert"), or bacteria were killed at 100° C. before adding to the cells ("heat-killed"). Photomicrographs of Giemsa-stained cells were taken at the same magnification. Bars=100 μm.

FIG. 2

Schematic map of the 54-kb pks-island.

The localization of transposon insertions in strains IHE3034 and SP15 resulting in loss of the cytopathic effect are indicated by black and grey flags, respectively. ORFs whose gene products are involved in peptide-polyketide synthesis and cytopathic effect are indicated in grey. ORFs not strictly required for the cytopathic effect are shown in white, transposase and integrase ORFs are shown in black.

ORF designations are given below the ORF symbols. The predicted protein functions are shown; ppt: phosphopantetheinyl transferase; nrps-pks: nonribosomal peptide synthetase-polyketide synthase; pks: polyketide synthase; hcdh: hydroxyl acyl coA dehydrogenase; acp: acyl carrier protein; dhg: αβ dehydrogenase; at: acyl-transferase; am: amidase; te: thioesterase. The domain prediction programs PFAM, PSI/PHI-BLAST, SEARCH NRPS-PKS and NRPS predictor were used in combination to analyze the domain structure of NRPS and PKS; A, adenylation; ACP/PCP, phosphopantetheine/acyl carrier; AT, acyltransferase; C, condensation; Cy, cyclisation; DH, dehydrogenase; ER, enoyl reductase; KR, ketoacyl reductase; KS, ketoacyl synthase; OX, oxidation.

FIG. 3A, FIG. 3B, FIG. 3C and FIG. 3D

Activation of the DNA-damage cascade and cell cycle arrest in HeLa cells exposed to pks-island+ *E. coli*.

Figure 3A:
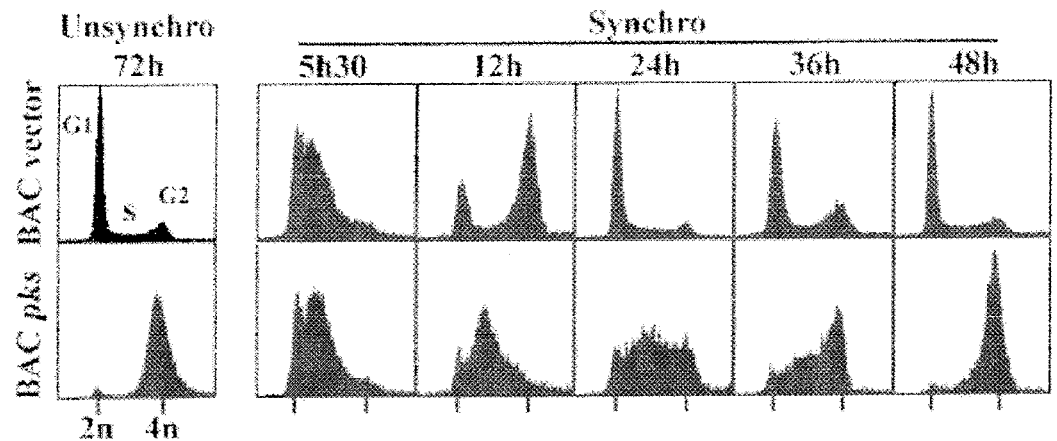

FIG. 3A: HeLa cells were synchronized in G1/S by a double thymidine block ("synchro") or left unsynchronized ("unsynchro"), then cells were exposed for 4 h to laboratory strain DH10B hosting the pks BAC (BAC pks) or the empty vector (BAC Vectors). The multiplicity of infection (MOI) was 100 bacteria per HeLa cell. The cell cycle progression was monitored by staining of cell DNA and flow cytometry at given times after infection.

Figure 3B:
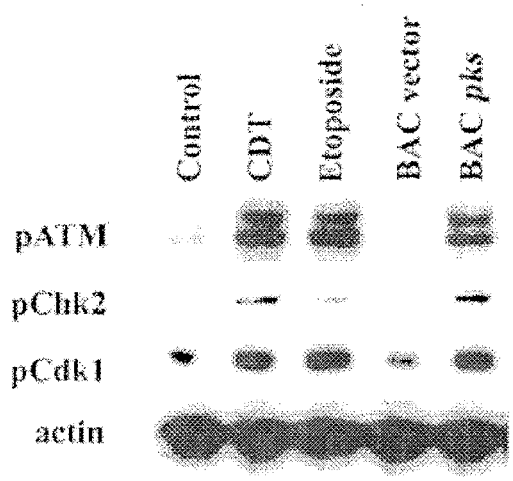

FIG. 3B: G1/S-synchronized HeLa cells were infected as before and the activation of key members of the DNA damage pathway (pATM, pCHk2 and pCdk1) was examined 48 h after infection by western blotting, using antibodies which recognize the phosphorylated forms of the proteins. As positive controls, cells were treated with etoposide and purified CDT, both known to activate the DNA-damage cascade response. Untreated cells (Control) are also shown. Actin is shown as a protein loading control.

Figure 3C:
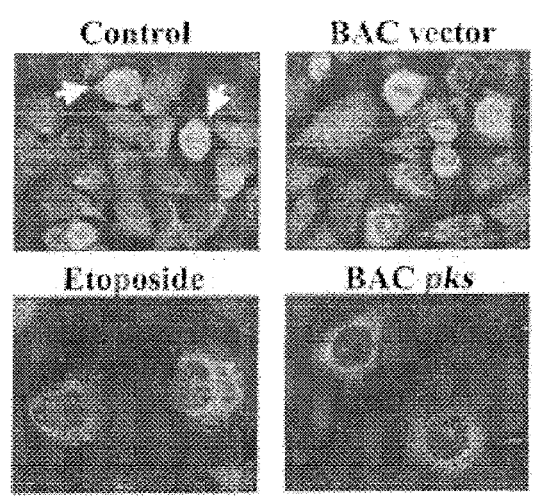

FIG. 3C: G1/S-synchronized HeLa cells were infected as before or treated with etoposide, then 48 hours following exposure intracellular localization of Cdc25C was observed by indirect immunofluorescence and confocal microscopy. Note Cdc25C cytoplasmic sequestration in transformed cells, whereas in controls Cdc25C was found in nuclei of dividing cells (arrows).

Figure 3D:
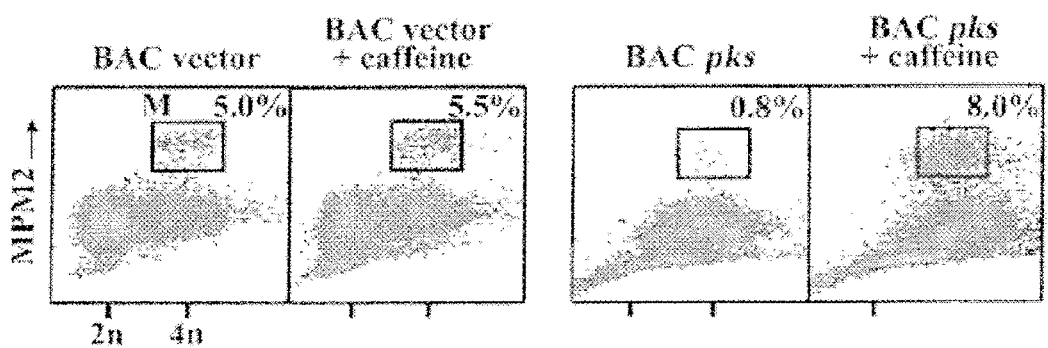

FIG. 3D: G1/S-synchronized HeLa cells were infected as before, incubated for 42 h and further treated or not with 1.5 mM caffeine for 6 h. Cell cycle distribution was analyzed by flow cytometry using propidium iodide to estimate DNA content and antibodies against mitotic phosphoproteins (MPM-2) to discriminate mitotic cells from G2 cells in the 4n population. Percentages of mitotic cells are shown on the bivariate analysis.

FIG. 4A, FIG. 4B, FIG. 4C and FIG. 4D

Exposure to pks-island+ *E. coli* induces host DNA double strand breaks.

Figure 4A:
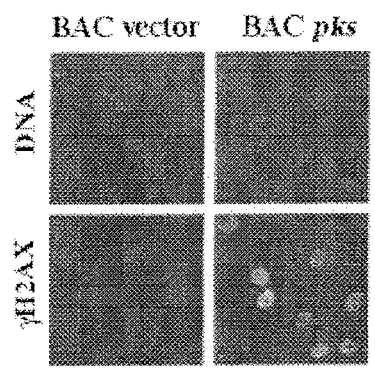

FIG. 4A: HeLa cells were exposed to DH10B hosting the BACpks or empty vector (BAC vector) (MOI=100) and 4 h after infection, examined by indirect immunofluorescence for phosphorylated H2AX (γH2AX) and for DNA.

Figure 4B:
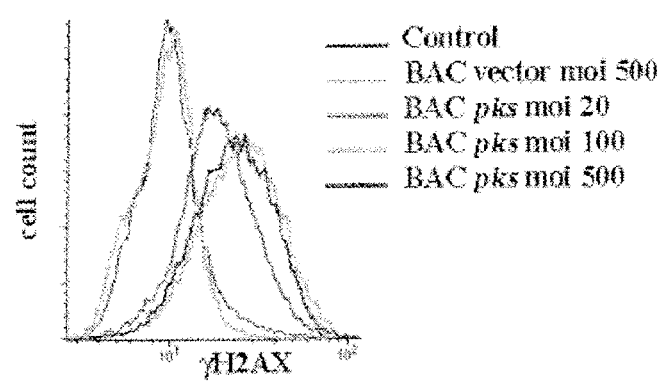

FIG. 4B: HeLa cells were infected with given doses of bacteria (MOI 20, 100 and 500), then 4 hours later, γH2AX was immunostained and quantified by flow cytometry.

Figure 4C:
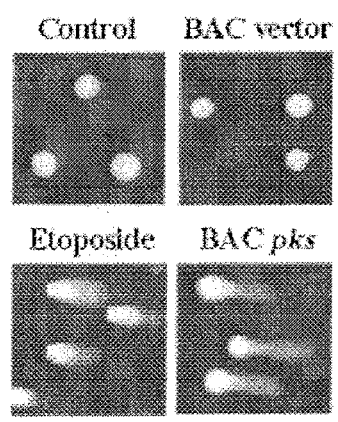

FIG. 4C: HeLa cells were infected as in FIG. 4A or treated with etoposide, then cells were embedded in agarose, lysed, subjected to an electric field in neutral condition that allows migration of broken DNA out of nuclei (neutral comet assay), DNA was stained and examined by fluorescence microscopy.

Figure 4D:
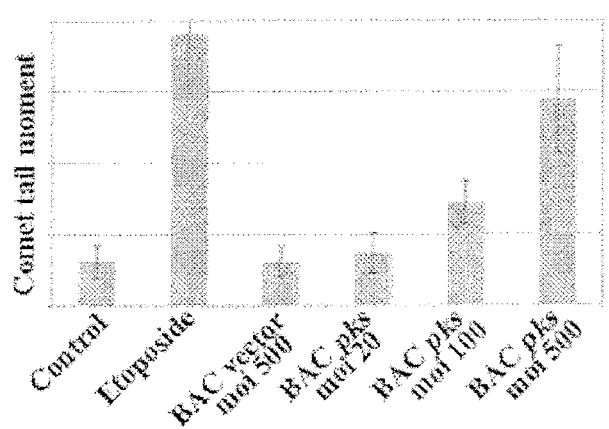

FIG. 4D: HeLa cells were infected as in FIG. 4B or treated with etoposide, the comet assay was performed and the mean comet tail moment was measured. Note that HeLa cell monolayers exposed to MOI=20 of DH10B pBACpks transform less than 50% of the cells, whereas an MOI of 100 and 500 transform 100% of the cells (data not shown).

FIG. 5

Transient infection of HeLa cells with the laboratory strain DH10B hosting a BAC bearing the complete pks-island resulted (BAC pks), within 3 days, in enlarged cell bodies and nuclei, while the cells did not divide. Directed mutation of the ppt gene in the BAC bearing the complete pks-island (ppt mutant) abrogates the cytopathic activity. Uninfected HeLa cells (Control) and HeLa cells infected with the laboratory strain DH10B hosting a empty vector (BAC vector) and with the live ExPEC strain IHE3034 are also shown.

FIG. 6A and FIG. 6B

Analysis of the distribution of the pks-island among Enterobacteriaceae.

FIG. 6A: Detection of the pks-island among strains of the E. coli collection of reference strains (ECOR). pks-island-positive strains are shaded in grey.

FIG. 6B: Schematic representation of the frequency of occurrence of the pks-island (or orthologues thereof) in complete genome sequences of E. coli, Shigella spp., Salmonella spp., Yersinia spp. included in the coliBASE database. Each ORF is indicated in a color code according to the percentage of the E. coli spp., Shigella spp., Salmonella spp. and Yersinia spp. genomes included into the comparison that contain an orthologue of the gene, as indicated on the scale bar (coliBASE genome browser). The chromosomal localization of the pks-island is indicated.

FIG. 7

Transcription of selected genes of the pks-island under in vitro growth conditions was analyzed by RT-PCR. Transcript levels of clbA (Phosphopantethinyl transférase, ORF20), clbB (Polyketide synthase, ORF18), clbC (polyketide synthase, ORF17) and clbD (3-hydroxybutylyl-CoA dehydrogenase, ORF 16) were analyzed by semi-quantitative RT-PCR. RNA was extracted from bacterial cells grown in vitro in the presence (+ coculture) or absence (− coculture) of HeLa cells. Serial dilutions of the isolated RNA were used as indicated for RT-PCR analysis in order to compare the transcript levels between different growth conditions.

FIG. 8

Model of activation of G2 checkpoint by colibactin in epithelial cells.

Colibactin inflicts directly or indirectly DNA double strand breaks (DSB) in eukaryotic host cells exposed to E. coli strains carrying the pks-island. This damage activates the ATM-Chk2 signal transduction pathway, leading to cytoplasmic sequestration of Cdc25C and lack of dephosphorylation of Cdk1, eventually resulting in G2 block. Relevant phosphorylations are depicted by asterisks.

FIG. 9

Body weights of rats inoculated with E. coli strains Nissle 1917 ("WT") or Nissle 1917 Δpks ("MT").

FIG. 10

Presence of the challenge strains (bacterial counts; colony forming units on selective media) in the stools of rats inoculated with E. coli strains Nissle 1917 ("WT") or Nissle 1917 Δpks ("MT").

FIG. 11

Number of aberrant crypt foci (ACF) at day 45 following DMH induction in colons of rats inoculated with E. coli strain Nissle 1917 ("WT") or Nissle 1917 Δpks ("MT").

*Significant difference (Fisher's Least-Significant-Difference Test, $p<0.02$)

IDENTIFICATION OF A GENE CLUSTER WHOSE EXPRESSION PRODUCTS HAVE CYTOPATHIC EFFECTS ON CELLS

Experimental Procedures

Bacterial Strains and Plasmids

Archetypical E. coli strains used in this work are listed in Table 1. The set of 72 reference strains of E. coli isolated from a variety of hosts and geographical locations (ECOR strain collection; H. Ochman, R. K. Selander, J Bacteriol 157, 690 (February, 1984)). The collection of 55 intestinal pathogenic E. coli isolates, 97 extraintestinal pathogenic E. coli isolates and 32 fecal strains belongs to the strain collection of the Institut für Molekulare Infektionsbiologie which has already been used for the investigation of the distribution of pathogenicity islands in pathogenic and non-pathogenic E. coli (U. Dobrindt et al., Infect Immun 70, 6365 (November, 2002), G. Schneider et al., Infect Immun 72, 5993 (October, 2004)).

TABLE 1

Archetypical E. coli strains

| Name | Origin | Reference |
|---|---|---|
| IHE3034 | ExPEC O18:K1:H7, from newborn meningitis | Korhonen et al., 1985, Infect Immun, 48: 486 |
| SP15 | ExPEC | J. R. Johnson et al., 2002, Journal of Infectious Diseases 185, 774 |
| J96 | ExPEC O4:K6:H5, from pyelonephritis | Hull et al., 1981, Infect Immun, 33: 933 |
| CFT073 | ExPEC O6:K2:H1, from acute pyelonephritis | Mobley et al., 1990, Infect Immun, 58: 1281 |
| 536 | ExPEC O6:K15:H31, from urinary tract infection | Hacker et al., 1990, Microb Pathog, 8: 213 |
| Nissle 1917 | Commensal O6:K5:H1, probiotic | L. Grozdanov et al., 2004, Journal of Bacteriology 186, 5432 |
| E2348/69 | EPEC O127:H6, from infantile diarrhea | Levine et al., 1978, Lancet, 1: 1119 |
| EDL933 | EHEC O157:H7, from an hamburger inducing hemorrhagic colitis | Riley et al., 1983, N Engl J Med, 308: 681 |

DNA Sequencing and Sequence Analysis

The BAC (Bacterial Artificial Chromosome) library was prepared by cloning Hind III-partially digested and size-separated genomic DNA of *E. coli* IHE3034 into the pBeloBAC11 vector as previously described (C. Buchrieser et al., *Infect Immun* 67, 4851 (September, 1999)). The size distribution of inserts ranged between 70 to 150 kb, with an average size of 100 kb, as judged from PFGE analysis of a representative sample of randomly picked BAC plasmids digested by Not I. This library was screened by PCR. BAC clone 11/2 covering the entire pks-island and the flanking regions of *E. coli* strain IHE3034 was sequenced as follows: small insert libraries (2-2.5 kb) were generated by mechanical shearing of cosmid DNA (P. J. Oefner et al., *Nucleic Acids Res* 24, 3879 (Oct. 15, 1996)). After end repair with T4 polymerase, the fragments were ligated into pTZ19R vector. Resulting plasmids were sequenced from both ends on ABI-377 automated DNA sequencers (Applied Biosystems). After assembly, the remaining gaps were closed by primer walking on the plasmid clones. The Phrap software implemented in the STADEN software package was used for assembly and editing the sequence data (R. Staden, K. F. Beal, J. K. Bonfield, *Methods Mol Biol* 132, 115 (2000)). The nucleotide sequence of the complete pks-island was submitted to the EMBL database. Homology searches were performed with the BLASTN, BLASTX and PSI- and PHI-BLAST programs of the National Center for Biotechnology Information (S. F. Altschul et al., *Nucleic Acids Res* 25, 3389 (Sep. 1, 1997)).

Cloning and Mutagenesis Procedures

Transposon mutant libraries of ExPEC strains IHE3034 and SP15 were prepared using the EZ::TN Kan-2 kit (Epicentre). Insertion locations of selected mutants were determined by arbitrary PCR and sequencing of PCR product.

Mutant strains in targeted genes were engineered using lambda red recombination (K. A. Datsenko, B. L. Wanner, *Proc Natl Acad Sci USA* 97, 6640 (Jun. 6, 2000)). Mutagenesis primers are described in table 2. Successful mutagenesis was confirmed by PCR using flanking primers. These primers are described in table 3.

PAI deletion in strain IHE3034 was achieved by Flp recombinase action on FRT sites inserted upstream and downstream of the island via lambda red recombination. One FRT site was chromosomally inserted upstream of ORF 1 using a PCR product amplified from pKD3 using the primer pair PKS1_new and PKS1.1_noFRT_pKD3. A second FRT site was chromosomally inserted downstream of ORF 22 using a PCR product amplified from pKD3 using the primers PKS2_new and PKS2.1_noFRT_pKD4. Successful deletion was confirmed by Southern blot analyses and PCR using flanking primers pks-islandleft.1/2, pks-islandright.1/2, ORF9-10.1/2 (Table 4).

TABLE 2

Mutagenesis primers

| Primer name | Primer sequence (5' to 3') | Target gene |
|---|---|---|
| IHAPJPN31 (SEQ ID NO: 171) | GGT GTT CAC AGG ATG ACA ATA ATG GAA CAC GTT AGC ATT AAA ACA TTA TAG TGT AGG CTG GAG CTG CTT C | clbP |
| IHAPJPN32 (SEQ ID NO: 172) | CGG CAA GCG AAA CAT CAC TAT TAC CAC GCC AAC TGT TAC TCA TCG CCT CAC ATA TGA ATA TCC TCC TTA G | clbP |
| IHAPJPN33 (SEQ ID NO: 173) | TGC CGA TGT TTG TCG GTA TGT TAA CGC AGG TGA CCT ATG CCA TCG CCG ATG TGT AGG CTG GAG CTG CTT C | clbM |
| IHAPJPN34 (SEQ ID NO: 174) | AGT AAA CAG GGG ATA CAT CCA GGG TGC CAG TAC AAT ATG CAT AAC GGC TAC ATA TGA ATA TCC TCC TTA G | clbM |
| IHAPJPN35 (SEQ ID NO: 175) | atg gct gtt cca tca tca aaa gaa gag tta att aaa gct att aat agt Tag tgt agg ctg gag ctg ctt c | c2450 |
| IHAPJPN36 (SEQ ID NO: 176) | ATT ATA CCA AGG TTT ACC GTA AAG CTC ATC GTT ACT GAA TCG TTC AAT CAC ATA TGA ATA TCC TCC TTA G | c2450 |
| IHAPJPN44 (SEQ ID NO: 177) | GGA CAT ACT AGT TTT TTT CAT CAA ACC AGT AGA GAT AAC TTC CTT CAC TAG TGT AGG CTG GAG CTG CTT C | clbA |
| IHAPJPN45 (SEQ ID NO: 178) | TTA GCT GAT AGT CGT GGT GAT AAA GTT GGG ACT GCA TAG GAA ATA GCT CAC ATA TGA ATA TCC TCC TTA G | clbA |
| IHAPJPN57 (SEQ ID NO: 179) | ATC AGT TTG TAT TGT TTG CCA TAT TCA GGT GGT TCT GCC GCC ATG TAT TAG TGT AGG CTG GAG CTG CTT C | clbQ |
| IHAPJPN58 (SEQ ID NO: 180) | GTG ATT CAA TCG TCT GGT TCA CAT AAC CTA CCA CCT GTT CAA AAT GCT TAC ATA TGA ATA TCC TCC TTA G | clbQ |
| IHAPJPN59 (SEQ ID NO: 181) | GCA CAG TTG GCG TCC GGA GAA ACC ACC TCA GTG GCG TTG GTG AAT CAC TAG TGT AGG CTG GAG CTG CTT C | clbL |
| IHAPJPN60 (SEQ ID NO: 182) | AAT GTT CGT TGT AAT CTT GCG GTT CGC CAT TGA CGA TAA GCT TGC GCT TAC ATA TGA ATA TCC TCC TTA G | clbL |
| IHAPJPN63 (SEQ ID NO: 183) | CAA ATC ATG GTC GGC AAT GAC AAA GAT CAT TTG ACG TCC CAA CTG GCT TAG TGT AGG CTG GAG CTG CTT C | clbK |
| IHAPJPN64 (SEQ ID NO: 184) | CAA AGA ATG CGC TTA GCG TAC AGG TGA TGC CGT AAC GTT GCT GAA TAT CAC ATA TGA ATA TCC TCC TTA G | clbK |

TABLE 2-continued

Mutagenesis primers

| Primer name | Primer sequence(5' to 3') | Target gene |
|---|---|---|
| IHAPJPN67 (SEQ ID NO: 185) | CAG GCG GCC ATT GGT AAC GAC AAA GAC AGT ATC ACT ACT ACC ATC GCC TAG TGT AGG CTG GAG CTG CTT C | clbI |
| IHAPJPN68 (SEQ ID NO: 186) | GCG CAA GGC GTT CGC CTT GGG CTA ACG AGA CTT CTG CTC TGA ACA ACT CAC ATA TGA ATA TCC TCC TTA G | clbI |
| IHAPJPN71 (SEQ ID NO: 187) | GAG TTG CTG GCC GAA GGC GTC GAA CAG AGT ACT CTG GAC AAC CCG CCT AGT GTA GGC TGG AGC TGC TTC | clbC |
| IHAPJPN72 (SEQ ID NO: 188) | CAC TCG GCG GCA ATC AAA CAC GGG GCG CGC CAC TTG TTG TGT GTA GGC TAC ATA TGA ATA TCC TCC TTA G | clbC |
| IHAPJPN79 (SEQ ID NO: 189) | ATG TTC CCT GGC TCC GGT TCG CAA TAT GTA GGC ATG GCA CGG TGG CTG TAG TGT AGG CTG GAG CTG CTT C | clbG |
| IHAPJPN80 (SEQ ID NO: 190) | GGC TTC CGG ATC GGT CTT CAC CGC CAT GTT ATC CCC CAG CAC CAA TGC TAC ATA TGA ATA TCC TCC TTA G | clbG |
| IHAPJPN87 (SEQ ID NO: 191) | GCC GGG TAC TTA GGT GCG TCA ATC CCC CAA AAA TAT GGC GGA CGA GGT TAG TGT AGG CTG GAG CTG CTT C | clbF |
| IHAPJPN88 (SEQ ID NO: 192) | GTA TTC CGC CGC GCT GAA GCA CAT TAG TTG CGC ACT GCG CGT TTG GGT CAC ATA TGA ATA TCC TCC TTA G | clbF |
| IHAPJPN91 (SEQ ID NO: 193) | CAG ACG TAC GCC GAG CAG TGA TTC TGG GTT AAC CAG ATA GGG ATA TGA ATG TGT AGG CTG GAG CTG CTT C | clbE |
| IHAPJPN92 (SEQ ID NO: 194) | TCA ACC TGA AAA TTT TTT TCT ATA AAC AGT ATG ATT TGC ACA GTA AAT TAC ATA TGA ATA TCC TCC TTA G | clbE |

TABLE 3

Cloning primers

| Primer name | Primer sequence (5' to 3') | Target gene |
|---|---|---|
| IHAPJPN29 (SEQ ID NO: 195) | GTG AAC TGA GCG AAA TAT TGG CTA ATC | clbP |
| IHAPJPN30 (SEQ ID NO: 196) | TTA CTC ATC GTC CCA CTC CTT GTT G | clbP |
| IHAPJPN37 (SEQ ID NO: 197) | GAT CGT GCT ATT TCA TGG CG | c2450 |
| IHAPJPN38 (SEQ ID NO: 198) | CAC ATT TTA TCC GTA TCA TTA ACC AG | c2450 |
| IHAPJPN43 (SEQ ID NO: 199) | TCC AGA GGT ATT ATC CAT AAC | clbB |
| IHAPJPN46 (SEQ ID NO: 200) | CTA GAT TAT CCG TGG CGA TTC | clbA |
| IHAPJPN55 (SEQ ID NO: 201) | TTA TCC TGT TAG CTT TCG TTC | clbQ |
| IHAPJPN56 (SEQ ID NO: 202) | CTT GTA TAG TTA CAC AAC TAT TTC | clbQ |
| IHAPJPN61 (SEQ ID NO: 203) | CAA CTG CAC AAT CTA CCC GCC | clbL |
| IHAPJPN62 (SEQ ID NO: 204) | GCT GTC ACC GAT ATC CGC CTC | clbL |
| IHAPJPN65 (SEQ ID NO: 205) | GAC AAG CTT GCA CAA CTC GGT G | clbK |
| IHAPJPN66 (SEQ ID NO: 206) | CAA CTT AAT CCC TCG ATG GTG G | clbK |

TABLE 3-continued

Cloning primers

| Primer name | Primer sequence (5' to 3') | Target gene |
| --- | --- | --- |
| IHAPJPN69 (SEQ ID NO: 207) | ATG CTG AAC TTG ATG CCG CAC | clbI |
| IHAPJPN70 (SEQ ID NO: 208) | GCT AAG GCA TAC TCG ACG CTG | clbI |
| IHAPJPN73 (SEQ ID NO: 209) | GTC ACC TTC TTT AGC GAG GAG | clbC |
| IHAPJPN74 (SEQ ID NO: 210) | GCT TGC GTA CCA TCG TTT TCC | clbC |
| IHAPJPN81 (SEQ ID NO: 211) | GTC GAA CGT TAC TAC CGC GAC | clbG |
| IHAPJPN82 (SEQ ID NO: 212) | TAC GTA AAA TGG CGT GAC GGG | clbG |
| IHAPJPN89 (SEQ ID NO: 213) | GTT ATT TAC TGT GCA AAT CAT ACT G | clbF |
| IHAPJPN90 (SEQ ID NO: 214) | ACA TCA GTG CGA CAT CCT TCG | clbF |
| IHAPJPN93 (SEQ ID NO: 215) | CAG GGT ATT TGG GCG TGA AAT C | clbE |
| IHAPJPN94 (SEQ ID NO: 216) | CGC AAG AAA TAA TGT CTG GCA C | clbE |

TABLE 4

Primers for deletion of the pks island

| Primer name | Primer sequence (5' to 3') |
| --- | --- |
| PKS1_new (SEQ ID NO: 217) | AAA AAT GGT GGT CAA ATC TGG GGT CAG GTT AGT TCG ATA ATG GAG TGA CCC CCA TGT GTA GGC TGG AGC TGC TT |
| PKS1.1_noFRT_pKD3 (SEQ ID NO: 218) | CAG CGC GCT ACA CGC CAT GCC CCG GAA ACC ATG ACC GCA GAT ATC TTG TTT CGT GTG CAG AAT AAA TAA ATC CTG GTG TC |
| PKS2_new (SEQ ID NO: 219) | AGA AGC TTT CCA CGC AGG CAT TAT CGT AGC AGC AGT GTA AAT AGA CCC ATT TTA CAT ATG AAT ATC CTC CTT AGT TCC TA |
| PKS2.1_noFRT_pKD4 (SEQ ID NO: 220) | TCC TAT GCA GTC CCA ACT TTA TCA CCA CGA CTA TCA GCT AAT TCA TTC GTC AAA TGG GCA GCT TGC AGT GGG CTT ACA T |

Cloning of genes for mutant complementation was performed by high fidelity PCR amplification (DeepVent, New England Biolabs) and cloning into pCR-Script (Stratagene) or pCR-Blunt II-TOPO (Invitrogen). When needed, genes were subcloned into suitable vectors (pASK75, pBRSK).

Detection of the pks-Island in Different *E. coli* Isolates

The presence of the pks-island among the strains of the ECOR and IMIB strain collections was analyzed by PCR using the primer pairs compiled in Table 5.

TABLE 5

Primers for the detection of the pks island

| Primer name | Primer sequence (5' to 3') | PCR product size [bp] |
| --- | --- | --- |
| pks-islandleft.1 (SEQ ID NO: 221) | AAT CAA CCC AGC TGC AAA TC | |
| pks-islandleft.2 (SEQ ID NO: 222) | CAC CCC CAT CAT TAA AAA CG | 1824 |
| pks-islandright.1 (SEQ ID NO: 223) | AGC CGT ATC CTG CTC AAA AC | |
| pks-islandright.2 (SEQ ID NO: 224) | TCG GTA TGT CCG GTT AAA GC | 1413 |
| ORF5-6.1 (SEQ ID NO: 225) | TCT GTC TTG GTC GCG TAG TG | |
| ORF5-6.2 (SEQ ID NO: 226) | TCA GTT CGG GTA TGT GTG GA | 2304 |
| ORF9-10.1 (SEQ ID NO: 227) | ATT CGA TAG CGT CAC CCA AC | |
| ORF9-10.2 (SEQ ID NO: 228) | TAA GCG TCT GGA ATG CAG TG | 2119 |
| ORF11-12.1 (SEQ ID NO: 229) | CGC TTC ATC AAC ACG CTT TA | |
| ORF11-12.2 (SEQ ID NO: 230) | CGC ATC AGG ATG TTC TGC TA | 2118 |
| ORF14-16.1 (SEQ ID NO: 231) | TCA TCG CAA TTT GGA TTT CA | |
| ORF14-16.2 (SEQ ID NO: 232) | TGA TGA ACG TGG CGG TAA TA | 2255 |
| ORF17-18.1 (SEQ ID NO: 233) | CCT CGC TAA AGA AGG TGA CG | |

TABLE 5-continued

Primers for the detection of the pks island

| Primer name | Primer sequence (5' to 3') | PCR product size [bp] |
|---|---|---|
| ORF17-18.2 (SEQ ID NO: 234) | ACC GTT GAC TGT GAT GGA CA | 2421 |
| ORF18-20.1 (SEQ ID NO: 235) | ATT TCG CCC TGA TAT TGT CG | |
| ORF18-20.2 (SEQ ID NO: 236) | CCT TCG TTG GCA GAT TGA TT | 2460 |

Analysis of Transcript Levels

Transcription levels were determined by limiting-dilution RT-PCR. Bacterial RNA was isolated by standard procedures at different time points of infection. PCR was performed on serially diluted cDNA ($1\text{-}128 \times 10^{-2}$) reverse transcribed from 4 µg RNA (SuperScript III, Invitrogen). Transcription levels were compared to those of bacteria grown under same conditions in interaction medium only (DMEM, 5% FCS, 25 mM HEPES). The primer sequences are compiled in Table 6.

TABLE 6

Primers for RT-PCR analysis

| Primer name | Primer sequence (5' to 3') | PCR product size [bp] |
|---|---|---|
| RT_ORF1_up: (SEQ ID NO: 237) | CTG TAT CTG CTG GTC AAA CC | |
| RT_ORF1_lp: (SEQ ID NO: 238) | AGC TCG GTA ACT GGT AGA TG | 344 |
| RT_ORF2_up: (SEQ ID NO: 239) | TGA ACC TCT ATT GGA AGG GC | |
| RT_ORF2_lp: (SEQ ID NO: 240) | GGC GAG GCG GTA TTA AAT TG | 357 |
| RT_ORF3_up: (SEQ ID NO: 240) | GTG AAA CAC TAC ACA GGT GG | |
| RT_ORF3_lp: (SEQ ID NO: 240) | CAC GAT CGG ACA GGT TAA TG | 348 |
| RT_ORF4_up: (SEQ ID NO: 240) | GAT GTG GCT AGT CAG AAA GC | |
| RT_ORF4_lp: (SEQ ID NO: 240) | CAT AAT TGG CGG AGG CAT AG | 343 |
| RT_ORF5_up: (SEQ ID NO: 241) | GCA CAG AAG ACG ATA ATG GG | |
| RT_ORF5_lp: (SEQ ID NO: 242) | CCT GAG CAC ACA AGT AAT CC | 327 |
| RT_ORF6_up: (SEQ ID NO: 243) | TTT GTG ATG GGA GAG GAG AG | |
| RT_ORF6_lp: (SEQ ID NO: 244) | CAG AAA TGC GCT ATA GGC TG | 348 |
| RT_ORF7_up: (SEQ ID NO: 245) | GGT ATG TTA ACG CAG GTG AC | |
| RT_ORF7_lp: (SEQ ID NO: 246) | CAC GAT CGC AAA GAA TAG CG | 252 |
| RT_ORF8_up: (SEQ ID NO: 247) | GCA CGG ATT ACC TTG TAC TG | |
| RT_ORF8_lp: (SEQ ID NO: 248) | GTG AGC AAA CAA AAT CGC TG | 323 |
| RT_ORF9_1_up: (SEQ ID NO: 249) | GGA CAT GCA GAG CTA CAA AG | |
| RT_ORF9_1_lp: (SEQ ID NO: 250) | CTC AAG TGC CTG CTG AAT AC | 328 |
| RT_ORF9_2_up: (SEQ ID NO: 251) | CGC TGA ACA ACG TCT ATG AG | |
| RT_ORF9_2_lp: (SEQ ID NO: 252) | GAC CAT GAT TTG GAG ACC AC | 266 |
| RT_ORF10_up: (SEQ ID NO: 253) | CTG TCG TTT AAT CAG GAG CG | |
| RT_ORF10_lp: (SEQ ID NO: 254) | CTG AAT TAC CGC ATC TAG CG | 282 |
| RT_ORF11_up: (SEQ ID NO: 255) | TAC TAC CAT CGC CTA TCA CC | |
| RT_ORF11_lp: (SEQ ID NO: 256) | GAC CGC ATA GAT GTT ATC GC | 325 |
| RT_ORF12_up: (SEQ ID NO: 257) | CTG GAT GCA GAA CGC TTA TC | |
| RT_ORF12_lp: (SEQ ID NO: 258) | GGA TCC TGT TTC ATC TCC AG | 255 |
| RT_ORF13_up (SEQ ID NO: 259) | GTC GGG TAC TTT GGT ACA AC | |
| RT_ORF13_lp (SEQ ID NO: 260) | CCC TTG CTT GAT GAT AGT GG | 283 |
| RT_ORF14_up (SEQ ID NO: 261) | GTA CTT AGG TGC GTC AAT CC | |
| RT_ORF14_lp (SEQ ID NO: 262) | CAC GTT CAC TAA GTC ACT GC | 262 |
| RT_ORF15_up: (SEQ ID NO: 263) | CAT TAC GTG GGC ATA CGT TG | |
| RT_ORF15_lp: (SEQ ID NO: 264) | GAC GGT AGC AAT CTG TTC TG | 152 |
| RT_ORF16_up: (SEQ ID NO: 265) | CAC GGA TGA ATA CGA TCT GC | |
| RT_ORF16_lp: (SEQ ID NO: 266) | TAT CGA TAT CCT CAG CAC GG | 342 |
| RT_ORF17_up: (SEQ ID NO: 267) | GAG TGC GTC ACC TTC TTT AG | |
| RT_ORF17_lp: (SEQ ID NO: 268) | CGT AGC CAA TCC ACA TCT TC | 290 |

TABLE 6-continued

Primers for RT-PCR analysis

| Primer name | Primer sequence (5' to 3') | PCR product size [bp] |
|---|---|---|
| RT_ORF18_up: (SEQ ID NO: 269) | GCA GGA TGA CGG TAT TGA TG | |
| RT_ORF18_lp: (SEQ ID NO: 270) | GAT ATG CAG CCC AAT AGT CG | 323 |
| RT_intergenicORF18_ORF19_up (SEQ ID NO: 271) | CTA AAT GGC ACA CCT ATC CG | |
| RT_intergenicORF18_ORF19_lp (SEQ ID NO: 272) | GTA CTG CAT GAC TTA CAT GTT | 172 |
| RT_ORF19_up: (SEQ ID NO: 273) | CCG TTA TCT CTG CGT GAA AG | |
| RT_ORF19_lp: (SEQ ID NO: 274) | AGC GTG ATT CGT ATT CCG AG | 156 |
| RT_ORF20_up: (SEQ ID NO: 275) | CTC CAC AGG AAG CTA CTA AC | |
| RT_ORF20_lp: (SEQ ID NO: 276) | CGT GGT GAT AAA GTT GGG AC | 164 |

Cell Culture, Treatments and Infection

HeLa, CHO, A375 and Caco-2 cells were maintained by serial passage in Dubelco's Modified Eagle medium (DMEM) supplemented with 10% foetal calf serum (FCS) and 50 µg/ml gentamicin. HeLa cells synchronization in G1/S was obtained by double thymidine block (incubation in 2 mM thymidine for 19 h, followed by thymidine free incubation for 9 h and further 2 mM thymidine for 16 h). Etoposide was added at 40 µM for 4 h to induce DNA double strand breaks in control cells. To inhibit ATM/ATR, caffeine treatment was performed at 1.5 mM for 8 h. For bacterial infections, overnight LB cultures of E. coli were diluted in interaction medium (DMEM, 5% FCS, 25 mM HEPES) and cell cultures (~50% confluent) were infected with a multiplicity of infection of 100, or as indicated in the text. Cells were washed 3-6 times at 4 h after inoculation and incubated in DMEM 10% FCS 200 µg/ml gentamicin until analysis. For the insert assay, bacteria were separated from the cells with a 0.2 µm Anopore membrane Strip Insert (Nunc).

Immunofluorescence Microscopy

Giemsa staining was used for routine morphology visualization. For cytoskeleton examination, cells were fixed with PBS 4% formaldehyde, permeabilized with PBS 0.1% Triton, saturated with PBS 3% BSA, then F-actin was labeled with rhodamine-phalloidin (Molecular Probes), microtubules were stained with rat anti-α-tubulin (Sera-lab) followed by FITC-conjugated rabbit anti-rat antibodies (Vector), and DNA was labeled with DAPI (VectaShield, Vector). For demonstration of phosphorylated H2AX, cells were fixed in 95% methanol 5% acetic acid, saturated and stained with mouse monoclonal anti phospho-H2AX antibodies (Upstate) followed by goat anti-mouse-FITC antibodies (Zymed). Images were acquired using a Leica DMRB fluorescence microscope equipped with a DFC300FX digital camera. For Cdc25C intracellular localization, cells were fixed for 30 min at 4° C. in PBS 3.7% formaldehyde, permeabilized for 5 min with PBS 0.25% Triton-X100 and with a further incubation in 100% cold methanol for 10 min at −20° C., saturated then stained with anti-Cdc25C antibodies (C20, Santa Cruz) followed by FITC-conjugated secondary antibodies (Zymed). Images were acquired with an Olympus IX70 confocal microscope and Fluoview software FV500, the confocal aperture being set to achieve a z optical thickness of ~0.6 µm.

Western-Blot Analysis

HeLa cells were collected and $4-8 \times 10^5$ cells were suspended in 100 µl 1× Laemli loading buffer, sonicated for 5 seconds to shear DNA, then heated for 5 min at 100° C. Proteins were separated on 4-12% or 3-8% NuPage gradient gel (Invitrogen), transferred to nitrocellulose membranes, saturated in 10% milk buffer and probed with anti-phospho-ATM, anti-phospho-Chk2 (Cell Signaling Technology), anti-actin (ICN), followed by HRP-conjugated secondary antibodies and chemiluminescent autoradiography (Lumiglo, Cell Signaling Technology). Protein loading was normalized with anti-actin western blots.

Cell-Cycle and Flow Cytometry Analysis

Cells were collected by trypsination. For mitotic MPM-2 antigens staining, cells were cells were incubated in PBS 90% methanol for 1 h at −20° C., saturated with PBS 1% BSA then stained with anti-MPM-2 antibodies (Upstate) followed by FITC-conjugated secondary antibodies (Zymed). For phosphorylated H2AX staining, cells were fixed for 10 min at 37° C. in PBS 3.7% formaldehyde, permeabilized 30 min in 90% ice cold methanol, saturated and stained with anti-phospho-H2AX (Upstate) followed by FITC-conjugated secondary antibodies (Zymed). Cells were eventually suspended in PBS 10 µg/ml propidium iodide 1 mg/ml RNAse and DNA/antigens content in least $10^4$ cells was analyzed with a FACScalibur flow cytometer (Beckton Dickinson).

Comet Assay

Cells were collected by trypsination, embedded in agarose and the single-cell gel electrophoresis (Comet) assay was performed using Trevigen CometAssay kit. Electrophoresis conditions were 2 V/cm for 4 min in TBE (neutral) buffer. Comet images were acquired with a Leica DMRB fluorescence microscope and comet tail moment was quantified with Scion Image (version 4.0.3, plugin ScionComet1.3).

Results

Figure 1:
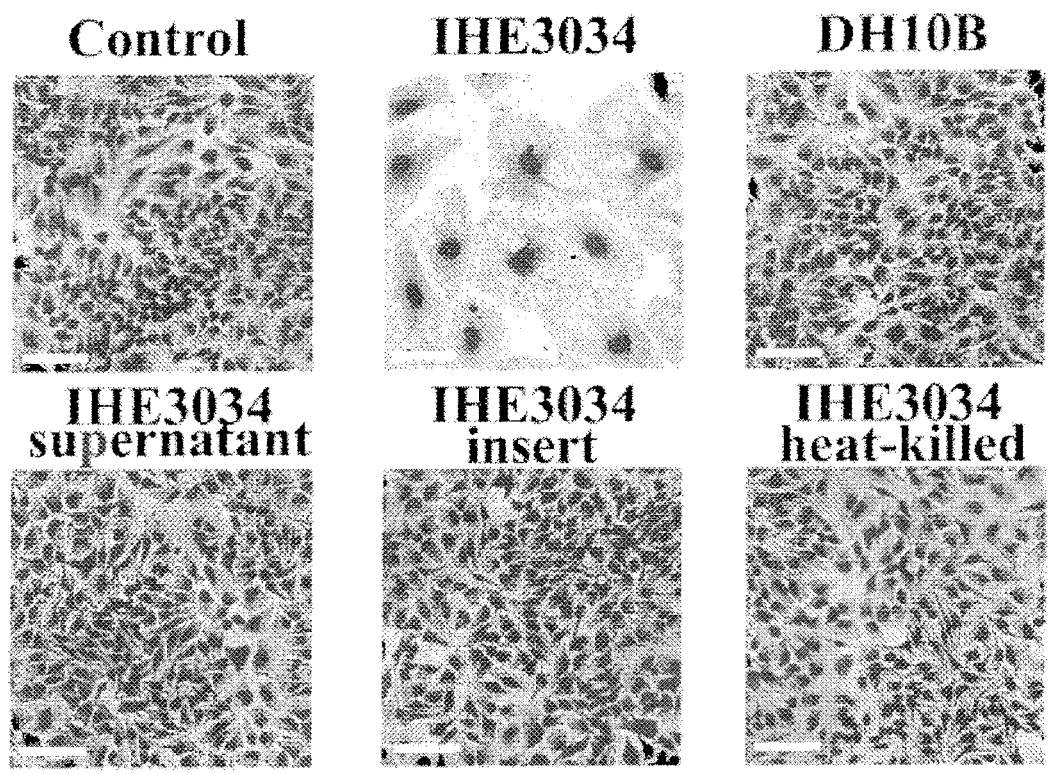
FIG. 1

In this study, the Inventors observed that certain E. coli strains induce in cultured eukaryotic cells a megalocytosis phenotype characterized by a cell body and nucleus enlargement and the absence of mitosis (FIG. 1), indicative of irreversible inhibition of cell proliferation. This cytopathic effect was observed upon transient infection of various cultured mammalian cells (HeLa, Caco-2, CHO, A375). This effect was induced by archetypical human pathogenic E. coli strains isolated from neonatal meningitis (e.g. IHE3034 and SP15), urinary tract infections (e.g. J96 and CFT073), and by commensal strains as well, but not by laboratory K-12 strains, enteropathogenic (E2348/69) or enterohemorrhagic (EDL933, Sakai) E. coli. The cytopathic activity was contact-dependent and was not observed when bacteria were separated from HeLa cells by a 0.2 µm permeable membrane (FIG. 1). In addition, heat-killed bacteria, bacterial culture supernatants, outer membrane vesicle fractions, outer membrane fractions and whole bacteria lysates were not cytotoxic (FIG. 1). This effect could not be explained by the production of toxins known to alter the host cell cycle such as Cytolethal Distending Toxins (5), Cycle Inhibiting Factor (6), Cytotoxic Necrotizing Factors (7), or by the production of α-hemolysin (8), and strains devoid of these toxin genes or engineered mutant strains remained cytopathic for HeLa cells.

Figure 2:
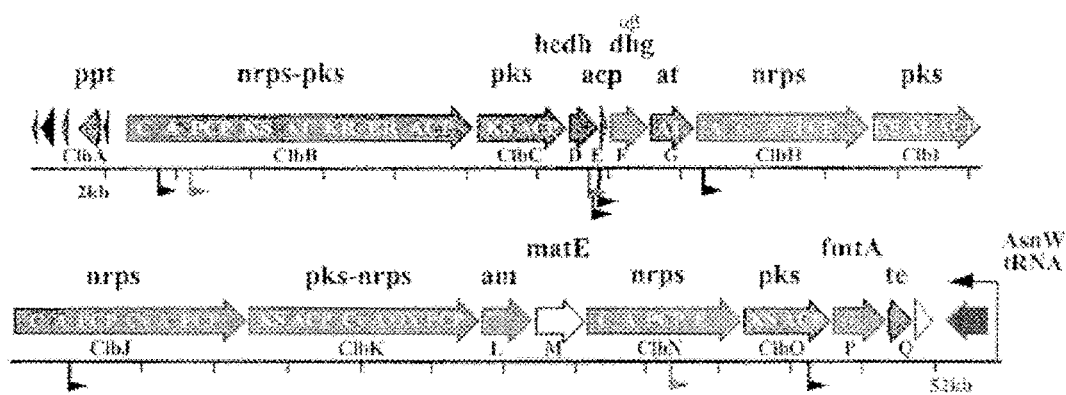

To identify the bacterial genes involved in this phenotype, the Inventors generated transposon mutants in two E. coli strains (IHE3034 and SP15) that induce in cultured eukaryotic cells the megalocytosis phenotype. Five thousand mutants were screened for the loss of induction of the cytopathic effect. Negative mutants in both strains had transposons clustered in a 54-kb chromosomal region (FIG. 2). This region exhibits typical features of a genomic island (GEI) and is inserted in the asnW tRNA locus, a frequent integration hot spot for foreign mobile DNA elements in E. coli (2). This genomic island exhibits a G+C content of 53.1%, is flanked by 16-bp direct repeats and carries a P4-like integrase gene downstream of the chromosomal insertion site. The genomic island was sequenced in newborn meningitis strain IHE3034 (accession number AM229678) and uropathogenic strain 536 (accession number CP00247). Sample sequencing of the corresponding chromosomal region of strain SP15 (9) and commensal strain Nissle 1917 (10) confirmed the presence of an identical GEI in these strains as well. The DNA sequences obtained were compared to the published sequence of strain CFT073 (11) which showed complete correspondence after re-sequencing of selected regions to correct for errors. To confirm the involvement of this genomic island in the induction of the megalocytosis phenotype, the entire island was deleted in strain IHE3034, resulting in a non-cytopathic mutant. In addition, a genomic BAC library of strain IHE3034 was screened and two BAC clones, BAC11 (insert ~67 kb) and BAC18 (insert ~76 kb), bearing the complete genomic island were identified. Laboratory E. coli strain DH10B hosting BAC11 or BAC18 triggered the megalocytosis and proliferation arrest in transiently infected cells as did parental strain IHE3034, whereas DH10B harboring the empty BAC vector did not induce any cytopathic effect (FIG. 5).

To test the distribution of this genomic island within the species E. coli, the Inventors performed a survey of 190 E. coli isolates including 55 intestinal pathogenic E. coli strains (enteroinvasive, enteropathogenic, enterohemorrhagic, enterotoxigenic and enteroaggregative E. coli), 97 extraintestinal pathogenic E. coli (ExPEC) strains and 32 strains isolated from the feces of healthy individuals. PCR-screening indicated that this genomic island is absent in intestinal pathogenic E. coli strains, but present in 53% and 34% of the ExPEC and fecal isolates, respectively. Furthermore, PCR-screening of the complete ECOR collection, which comprises strains of the six major phylogenic groups of E. coli (A, B1, C, E, D, and B2), indicated that this genomic island is restricted to, and widely distributed in the B2 group (FIG. 6A). This phylogenic group comprises commensals (12) and extraintestinal pathogenic strains (13). Specificity of this genomic island for ExPEC strains of phylogenic group B2 was further illustrated by the diagrammatic representation of the E. coli CFT073 circular genome where genes are coloured according to the presence of orthologues in different E. coli pathotypes and other Enterobacteriaceae (FIG. 6B). The strict association of this genomic island with strains of phylogenic group B2, shows that it has been acquired by a member of this group and is, since then, stably inherited.

Putative enzymatic functions of the ORFs encoded on this genomic island were identified (FIG. 2 and table 7). The genomic island, thereafter named pks-island, encodes a synthesis machinery for a non-protein, peptide-polyketide hybrid compound. This machinery consist of 3 nonribosomal peptide megasynthases (NRPS), 3 polyketide megasynthases (PKS) and 2 hybrid NRPS/PKS megasynthases. NRPS and PKS are large multifunctional enzymes found in bacteria and fungi that produce an immense variety of peptides and polyketides of broad structural and biological activity (14, 15). These molecules are widely used by the pharmaceutical and agro-industry, including antibiotics (e.g. erythromycin), immunosuppressants (e.g. cyclosporin, rapamycin), antiparasitics (e.g. avermectin) and antitumor agents (e.g. doxorubicin, epothilone, bleomycin). Also encoded on the locus are a phosphopantetheinyl transferase (required for post-translational activation of NRPS-PKS enzymes), a thioesterase (acting as a terminating enzyme), and the genes for 7 putative accessory, tailoring, editing enzymes (Table 7). To get a glance at the function of these PKS and NRPS in E. coli, their domain structures were analyzed in silico (FIG. 2) and revealed a typical but complex modular structure. Noteworthy is the thiazole-forming NRPS module in ClbK (composed of heterocyclization, cysteine-specific adenylation, oxidation and peptidyl carriage domains). Thiazole rings are signature pharmacophores common to many clinically important natural products, and are important functional elements e.g. intercalating DNA in the case of the peptide-polyketide bleomycin (16).

Figure 7:
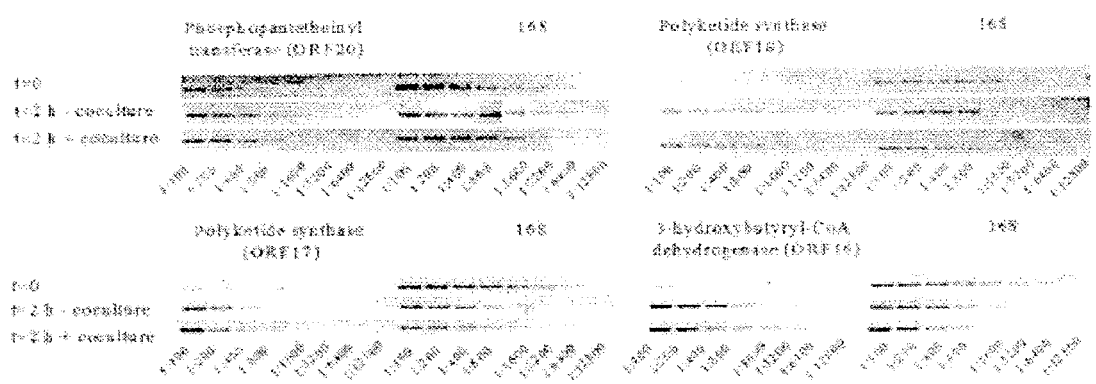

The Inventors conducted a systematic mutagenesis of the pks-island genes in DH10B hosting BAC18 (pBACpks). The different PKS and NRPS, the PPTase the thioesterase and 8 of 9 genes encoding putative accessory and tailoring enzymes were found to be required for the induction of the contact-dependant cytopathic effect. Only the mutation of the gene coding for a putative efflux pump of the MATE family (17) did not alter the cytopathic activity, possibly because other efflux pumps encoded elsewhere on the chromosome could rescue this mutation (FIG. 2, table 7). RT-PCR experiments indicated that the genes were transcribed under in vitro conditions as well as during contact with host cells (FIG. 7). These genetic analyses altogether indicate that the E. coli pks-island is necessary and sufficient, in an E. coli K-12 genetic background, for biosynthesis and delivery of a cytotoxic polyketide-peptide hybrid compound, for which the Inventors propose the name "Colibactin".

TABLE 7

Annotation of the pks-island genes of ExPEC strain IHE3034 and functional characterization of mutants.

| ORF number | Gene name | Putative function | Mutant cytopathic effect phenotype |
|---|---|---|---|
| 1 | c2449 | P4-like integrase | nd |
| 2 | c2450 | Hypothetical conserved protein | + |
| 3 | clbQ | Thioesterase | − |
| 4 | clbP | FmtA-like protein | − |
| 5 | clbO | PKS | − |
| 6 | clbN | NRPS | − |
| 7 | clbM | MATE-like protein | + |
| 8 | clbL | Amidase | − |
| 9 | clbK | PKS/NRPS | − |
| 10 | clbJ | NRPS | − |
| 11 | clbI | PKS | − |
| 12 | clbH | NRPS | − |
| 13 | clbG | Malonyl-CoA transacylase | − |
| 14 | clbF | Acyl-CoA-dehydrogenase | − |

TABLE 7-continued

Annotation of the pks-island genes of ExPEC strain
IHE3034 and functional characterization of mutants.

| ORF number | Gene name | Putative function | Mutant cytopathic effect phenotype |
|---|---|---|---|
| 15 | clbE | Acyl/D-alanyl carrier protein | − |
| 16 | clbD | 3-hydroxyacyl-CoA-dehydrogenase | − |
| 17 | clbC | PKS | − |
| 18 | clbB | NRPS/PKS | − |
| 19 | clbR | LuxR-like | nd |
| 20 | clbA | Phosphopantetheinyl transferase | − |
| 21 | c2472 | IS1400 transposase ORFA | nd |
| 22 | c2473 | IS1400 transposase ORFB | nd |
| 23 | c2474 | Transposase fragment | nd | nd: not done.

In an effort to characterize the mode of action of colibactin, the Inventors examined the cell cycle of eukaryotic cells transiently exposed to cytopathic E. coli strains. Flow cytometry analyses showed that the nucleus of the giant cells had a 4n DNA-content (FIG. 3A). This observation, together with the absence of mitosis in infected cell culture (FIG. 1), indicates that transformed cells were blocked at the G2/M transition. Time course experiments in which cells were synchronized at the G1/S transition then exposed to bacteria showed that DH10B pBACpks-exposed cells lagged in DNA synthesis (S) phase for 48 hours and eventually accumulated in G2/M, whereas control cells went through S phase in less than 12 hours and continued a normal cell cycle (FIG. 3A). These observations prompted the inventors to examine whether the checkpoint that stops the cell cycle in response to DNA injury was activated (18). Interestingly, ATM, a central protein in DNA-damage response (19), was activated (phosphorylated on Ser-1981) in DH10B pBACpks-exposed cells, but not in DH10B vector-exposed cells (FIG. 3B). Western blot analysis showed that ATM phosphorylation could be detected as early as 4 hours following exposure to DH10B pBACpks (not shown). The ATM signal-transducer Chk2 was also activated, as its phosphorylated form was detected (FIG. 3B). Chk2 is known to phosphorylate Cdc25 protein, resulting in its inactivation by cytoplasmic retention by 14-3-3 proteins. Indeed, the Inventors observed that Cdc25C was excluded from the nuclei of DH10B pBACpks-exposed cells whereas dividing control cells harbored nuclear Cdc25C (FIG. 3C). Nuclear translocation of Cdc25 phosphatases is required for the activating dephosphorylation of the key mitosis inducer Cdk1. Consistent with the nuclear exclusion of Cdc25C, the Inventors observed in DH10B pBACpks-exposed cells high levels of inactive phosphorylated (Tyr-15) form of Cdk1 (FIG. 3B), thus explaining the G2/M-block. Further evidence that the DNA-damage cascade is activated by colibactin was obtained by inhibiting ATM. HeLa cells exposed to DH10B pBACpks were treated with the ATM/ATR inhibitor caffeine (20). The G2-block was alleviated upon caffeine treatment since a significant number of cells reentered M-phase as demonstrated by the increase of mitotic phosphoproteins (MPM-2) positive cells in the 4n population (FIG. 3D). Together these results indicated that the DNA-damage signaling cascade, starting with ATM activation, is fully activated upon exposure to E. coli harboring the pks-island.

Figure 8:
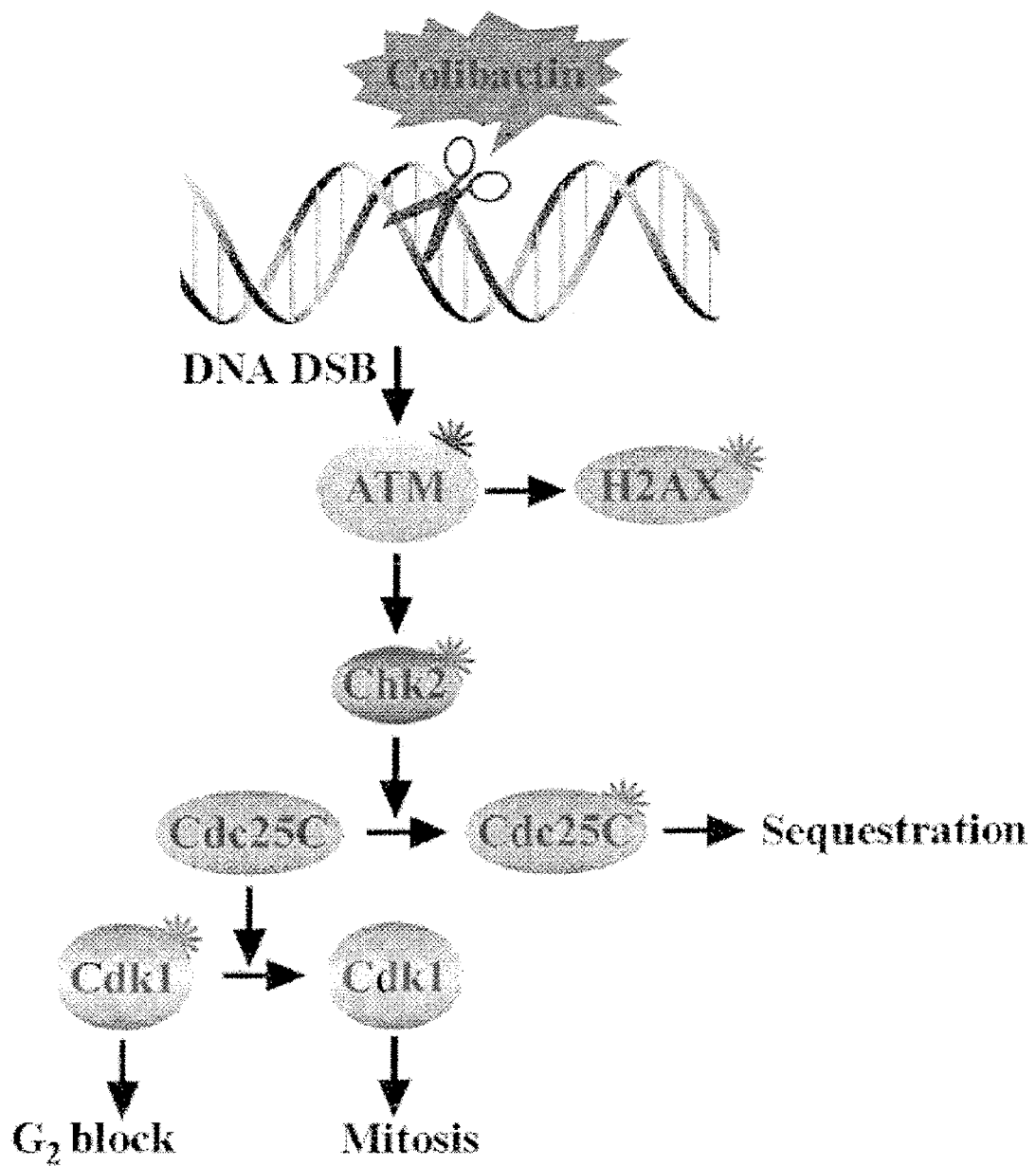

To further examine whether colibactin inflicts DNA injury, the Inventors monitored the phosphorylation of histone H2AX. Occurrence of phosphorylated H2AX (γH2AX), is a sensitive and quantitative marker of the number of DNA double strand breaks produced in a cell following exposure to DNA damaging agents (21). Transient infection of HeLa cells with DH10B pBACpks, but not with DH10B vector, resulted within 4 hours in a strong γH2AX nuclear signal (FIG. 4A). The γH2AX signal of the infected DH10B pBACpks cell population increased according to a dose related response reaching saturation at an infectious dose of bacteria sufficient to transform 100% of the cells (FIG. 4B). Similar results were obtained in infected CHO and Caco-2 cells. To further test the occurrence of DNA strand breaks in infected cells, the Inventors performed the neutral single cell gel electrophoresis (comet) assay. Four hours following exposure to bacteria, DNA lesions could be detected in cells exposed to DH10B pBACpks but not to DH10B vector (FIG. 4C). The comet tail moment increased with the number of infecting DH10B pBACpks bacteria (FIG. 4D), indicating increased amounts of DNA double strand breaks. The Inventors conclude that exposure to pks-island+E. coli induces host DNA double strand breaks, activating the DNA damage pathway response, culminating in G2 host cell cycle arrest (FIG. 8).

In conclusion, E. coli strains harboring a unique genomic island, widely distributed in both pathogenic and commensal isolates, induce DNA double strand breaks upon transient contact with epithelial cells. This genomic island is present in Nissle 1917, a commensal strain of E. coli which is an excellent colonizer in mice and humans and has been widely used as a probiotic treatment for intestinal disorders, such as ulcerative colitis (22) (23) (24). These bacteria constitute a predisposing factor for the development of intestinal cancer or help us to create novel therapies for cancer (27).

EVALUATION OF THE PKS-ISLAND HOSTED BY ESCHERICHIA COLI FOR USE TO PREVENT OR SUPPRESS COLORECTAL CANCER

A pks-island positive E. coli strain and an isogenic pks-island mutated strain were administered to rats and compared in a chemically-induced colon cancer model. This rodent model of colon carcinogenesis is widely used and is a good predictor of preventive efficacy in humans (European Journal of Cancer, 2005, 41: 1911)

Method

The challenge strains used were E. coli Nissle 1917 (pks-island positive) and Nissle 1917 Δpks in which the pks-island was deleted as described (Science, 2006, 313:848). Both strains were selected for spontaneous streptomycin resistance by plating on agar medium supplemented with 500 microgram/ml streptomycin.

Animal care followed the guidelines of the European Council on animals used in experimental studies. Twenty female Fisher 344 rats were obtained from Iffa Credo (Lyon, France) at 4 weeks of age. The rats were distributed randomly in individual stainless-steel wire-bottom cages, housed in a room kept at 22° C. on a 12-h light-dark cycle. The rats were allowed free access to tap water and to standard low calcium (20 μmol/g) AIN-76 diet (UPAE, INRA, Jouy, France).

Following 5 days of acclimatization, rats were injected i.p. with the carcinogen DMH (1,2-Dimethylhydrazine, 150 mg/kg body weight). Seven days later, they were randomly allocated to 2 experimental groups: group "WT" received E. coli strain Nissle 1917 and group "MT" received the Nissle 1917 Δpks strain. Each rat received 1 ml of fresh inoculum in phosphate buffered saline solution containing 10e9 live bacteria by gastric gavage three times a week for six weeks.

Body weights were monitored weekly throughout the experimentation. To monitor the colonization of rats with the challenge strains, stool samples were collected weekly, diluted and cultured on Mac Conkey agar plates supplemented with streptomycin.

On day 45 following DMH injection, all rats were euthanized by $CO_2$ asphyxiation in a random order. Colons were excised, washed in Krebs buffer solution, opened longitudinally and fixed in 10% buffered formalin. Aberrant crypt foci (ACF) were then scored following Bird's procedure (*Cancer Lett.,* 1987, 37: 147); colons were stained with methylene blue (0.1%) for 6 minutes and the mucosal side was observed at ×32 magnification. ACF scoring was done "blindly" in duplicate by two investigators who did not know the treatment group.

Results and Conclusion

Figure 9:
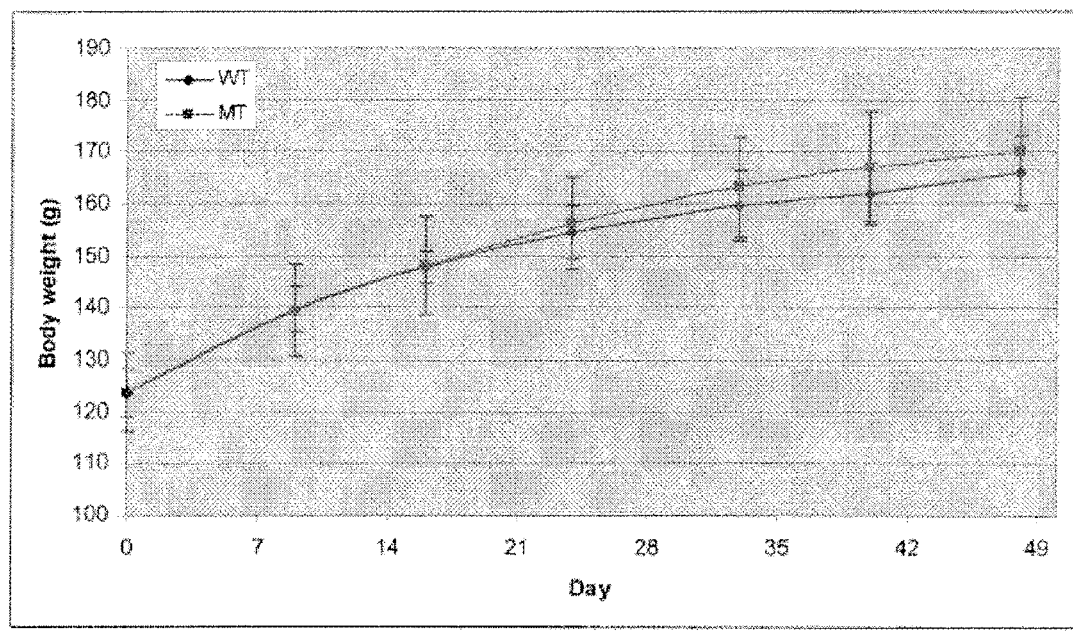

No significant difference of body weight gain was noted between the two experimental groups (FIG. 9).

Figure 10:
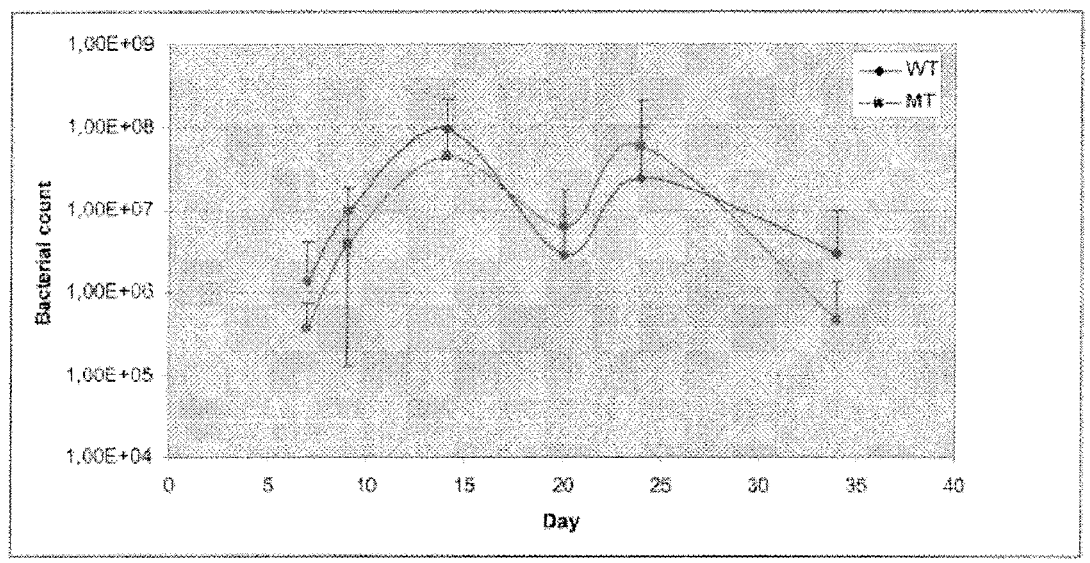

The two experimental groups shed the challenge strains at similar levels. Both Nissle 1917 and Nissle 1917 Δpks strains remained above 10e5 CFU/g throughout the experimentation (FIG. 10).

Figure 11:
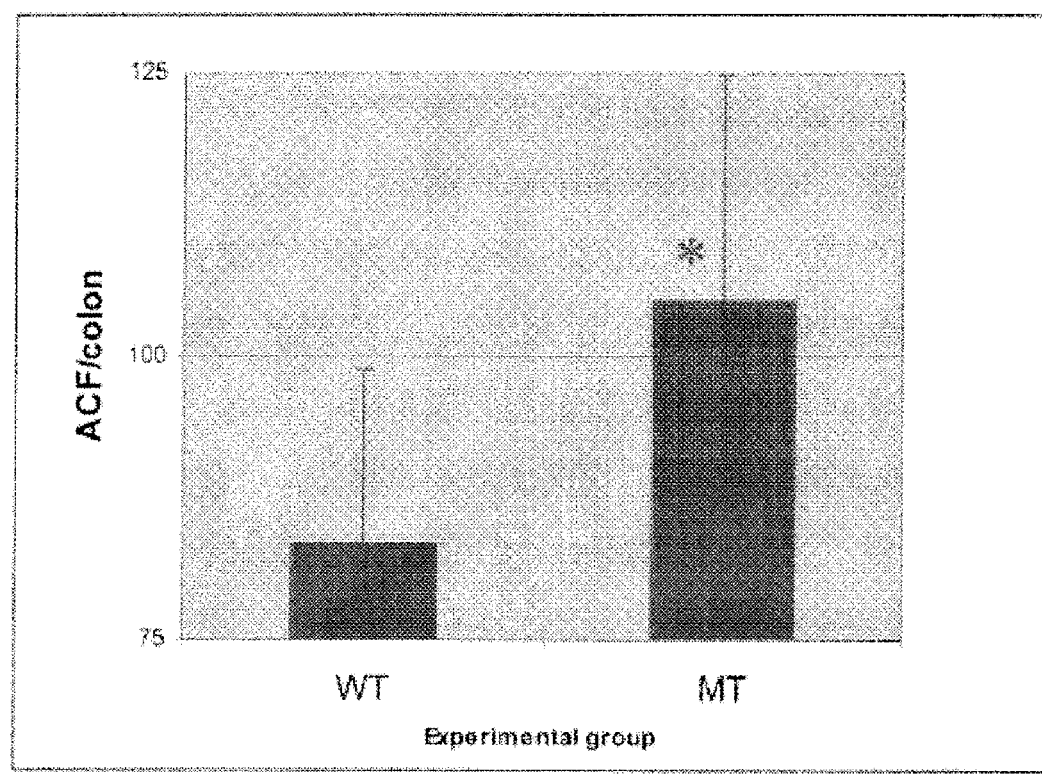

Rats administered with Nissle 1917 strain had a significantly reduced number of DMH-induced aberrant crypt foci (ACF) as compared to the number of ACF in rats that received the Nissle 1917 Δpks strain (FIG. 11).

This result indicates that presence of the pks-island confers a protective capacity to *E. coli* against the promotion of colorectal carcinogenesis.

The results of this animal study show that colorectal cancer may be prevented or suppressed by the utilization of *E. coli* hosting the pks-island as a probiotic.

DISTRIBUTION OF THE PKS-ISLAND AMONG MEMBERS OF THE ENTEROBACTERIACEAE

We tried to detect the pks-island by PCR in different enterobacteria. So far, the colibactin determinant could only be detected in *E. coli* isolates.

*E. coli* strains tested (n=421), pks-positive: 90 (only ExPEC and fecal isolates of ECOR group B2). Among the pks-positive strains that also express the polyketide colibactin are several fecal isolates ("commensals") which are non-hemolytic. They are currently screened for genes encoding other bacterial cyclomodulins, e.g. cytotoxic necrotizing factor and cytolethal distending toxin and may be used as alternatives to *E. coli* strain Nissle 1917.

The following isolates belonging to the family of Enterobacteriaceae were pks-negative:

TABLE 1

List of enterobacterial genera tested for the presence of the colibactin determinant

| Genus/species | Strains tested |
|---|---|
| *Escherichia fergusonii* | (n = 1) |
| *Escherichia hermannii* | (n = 1) |
| *Enterobacter cloacae* | (n = 1) |
| *Erwinia herbicola* | (n = 1) |
| *Providencia* sp. | (n = 1) |
| *Pantoea* spp. | (n = 2) |
| *Photorhabdus* spp. | (n = 2) |
| *Xenorhabdus* spp. | (n = 3) |
| *Citrobacter* spp. | (n = 5) |
| *Shigella* spp. | (n = 10) |
| *Salmonella* SARC collection | (n = 16) |
| *Serratia* spp. | (n = 17) |
| *Proteus* spp. | (n = 36) |

The inventors were able to detect the colibactin pks gene cluster in certain *Klebsiella* strains. 22 different *Klebsiella* isolates were tested and 5 of them were positive for at least seven out of eight screening PCR reactions covering different parts of the colibactin genes.

HETEROLOGOUS EXPRESSION OF THE PKS-ISLAND IN *PSEUDOMONAS PUTIDA*

The shuttle vector pME6030 that allows recombination in *E. coli* and in *Ps. putida* was recombined with pBELOBAC11pks. The latter BAC vector carries a DNA insert comprising the complete pks-island of newborn meningitis *E. coli* isolate IHE3034. The cointegrate of pME6030 and pBELOBAC11pks has been transformed into *Pseudomonas putida* strain KT2270. This strain does not express polyketides and its complete genome sequence is publicly available.

Upon transformation of *Pseudomonas putida* strain KT2270 with the pME6030::pBELOBAC11pks cointegrate, the resulting transformant exhibits the cytopathic effect similar to that obtained with colibactin-positive *E. coli* strain Nissle 1917.

REFERENCES

1. J. B. Kaper, J. P. Nataro, H. L. T. Mobley, *Nature Reviews Microbiology* 2, 123 (February, 2004).
2. J. Hacker, U. Hentschel, U. Dobrindt, *Science* 301, 790 (August, 2003).
3. B. B. Finlay, P. Cossart, *Science* 276, 718 (May, 1997).
4. J. P. Nougayrede, F. Taieb, J. De Rycke, E. Oswald, *Trends in Microbiology* 13, 103 (March, 2005).
5. M. Lara-Tejero, J. E. Galan, *Science* 290, 354 (October, 2000).
6. O. Marches et al., *Molecular Microbiology* 50, 1553 (December, 2003).
7. E. Oswald et al., *Proceedings of the National Academy of Sciences of the United States of America* 91, 3814 (April, 1994).
8. R. A. Welch, E. P. Dellinger, B. Minshew, S. Falkow, *Nature* 294, 665 (1981 December, 1981).
9. J. R. Johnson, E. Oswald, T. T. O'Bryan, M. A. Kuskowski, L. Spanjaard, *Journal of Infectious Diseases* 185, 774 (March, 2002).
10. L. Grozdanov et al., *Journal of Bacteriology* 186, 5432 (August, 2004).
11. R. A. Welch et al., *Proceedings of the National Academy of Sciences of the United States of America* 99, 17020 (December, 2002).
12. F. L. Nowrouzian, A. E. Wold, I. Adlerberth, *Journal of Infectious Diseases* 191, 1078 (April, 2005).
13. B. Picard et al., *Infection and Immunity* 67, 546 (February, 1999).
14. C. R. Hutchinson, *Proceedings of the National Academy of Sciences of the United States of America* 100, 3010 (March, 2003).
15. C. T. Walsh, *Science* 303, 1805 (March, 2004).
16. J. Y. Chen, J. Stubbe, *Nature Reviews Cancer* 5, 102 (February, 2005).
17. M. H. Brown, I. T. Paulsen, R. A. Skurray, *Molecular Microbiology* 31, 394 (January, 1999).
18. A. Sancar, L. A. Lindsey-Boltz, K. Unsal-Kacmaz, S. Linn, *Annual Review of Biochemistry* 73, 39 (2004).
19. C. J. Bakkenist, M. B. Kastan, *Nature* 421, 499 (January, 2003).

20. J. N. Sarkaria et al., *Cancer Research* 59, 4375 (September, 1999).
21. E. P. Rogakou, D. R. Pilch, A. H. Orr, V. S. Ivanova, W. M. Bonner, *Journal of Biological Chemistry* 273, 5858 (March, 1998).
22. W. Kruis et al., *Gut* 53, 1617 (November, 2004).
23. H. A. Malchow, *J Clin Gastroenterol* 25, 653 (December, 1997).
24. B. J. Rembacken, A. M. Snelling, P. M. Hawkey, D. M. Chalmers, A. T. Axon, *Lancet* 354, 635 (Aug. 21, 1999).
25. L. V. Hooper, J. I. Gordon, *Science* 292, 1115 (May, 2001).
26. K. K. Khanna, S. P. Jackson, *Nature Genetics* 27, 247 (March, 2001).
27. A. J. Lax, *Nature Reviews Microbiology* 3, 343 (April, 2005).
28. K. J. Weissman, P. F. Leadlay, *Nature Reviews Microbiology* 3, 925 (December, 2005).
29. L. H. Du, C. Sanchez, B. Shen, *Metabolic Engineering* 3, 78 (January, 2001).

SEQUENCE LISTING (170 sequences)

SEQ ID NO: 1 - DNA, 1269 bp, Escherichia coli
  CDS (1)..(1269): First CDS region
atgtcccttaacgacgcaaaaatccgtagtctcaagcccactgataaaccctttaaagtctccgattcccacggtctgtatctgctggtcaaaccaggcggttcccgtctctggtatcttaaataccgtattaatggcaaagaatcccgtattgcactgggtgcctaccctgccgtctccctgtctgacgcccgccagcagcgcgaaggcatccgtaagatgctggcgctgaacatcaacccggcgcagcaacgtgccgctgaacgcggctcgcgcatgcaggagaaaatgtttaaatccgtggcactggagtggcacagtagcaagaaaaaatggtcgcagaataccgcagatcgcgtgcttgcccgtctgaacagacatgtctttccgaccatcgggcatctaccagttaccgagcttaaatcacgtcatttcattgaattactgaaaggcattgaggaaaagggcttgcttgaagttgcgtcccgctcgcggcaacacctcagcaacattatgcgttatgctgttcatcaggggttaatcgaaatcaacccagctgcaaatcttgacggcgtgacggcttctcccgccagacgacattatcccaccctgccactggagcgccttcctgagctgcttgaacggattgacagttatcaccaaggacgggaactcaccaggcttgcagtcctgctgacgttgcatgtgttcattcgctcaagtgaactgcgctatgctcgttggacagagattaacttcagaaatcggatctggacgatacctgccacacgcgaagcgattgcaggcgtacgttattccagtcgaggtgccaaaatgcgtacaccgcatattgtgcccctttctgagcaggttatctctattctgaaaaggattaaggaaatatctggcgggtatgaactggtgttccccggctatcatgacccctacaagccgatgagtgaaaatactatcaataaggcacttcgccagatgggatacaacacgaaacaagatatctgcggtcatggtttccgggcaatggcgtgtagcgcgctgatggaatccggtttatggtcgcaagatgcagtggagcgtcagatgagtcaccaagagcgcaacactgtgcgtctggcttacattcataaggccgaacatatggaagcccgcatggacatgatgcagtggtggtcggattatctggatatgtgcagtgaaatctgggtgcccccgtacatctggagtcagcaaaacattaatctcgcagtaacc

SEQ ID NO: 2 - protein, 423 aa, Escherichia coli
MSLNDAKIRSLKPTDKPFKVSDSHGLYLLVKPGGSRLWYLKYRINGKESRIALGAYPAVSLSDARQQREGIRKMLALNINPAQQRAAERGSRMQEKMFKSVALEWHSSKKKWSQNTADRVLARLNRHVFPTIGHLPVTELKSRHFIELLKGIEEKGLLEVASRSRQHLSNIMRYAVHQGLIEINPAANLDGVTASPARRHYPTLPLERLPELLERIDSYHQGRELTRLAVLLTLHVFIRSSELRYARWTEINFRNRIWTIPATREAIAGVRYSSRGAKMRTPHIVPLSEQVISILKRIKEISGGYELVFPGYHDPYKPMSENTINKALRQMGYNTKQDICGHGFRAMACSALMESGLWSQDAVERQMSHQERNTVRLAYIHKAEHMEARMDMMQWWSDYLDMCSEIWVPPYIWSQQNINLAVT

SEQ ID NO: 3 - DNA, 510 bp, Escherichia coli
  CDS (1)..(510): First CDS region
atggctgttccatcatcaaaagaagagttaattaaagctattaatagtaatttttctttattaaataagaagctagaatctattacgccccaactcgcctttgaacctctattggaagggcacgcgaaggggactacgattagcgtagcgaatctggtttcctatctgattggctggggagagctggtgttacactggcatgaccaagaggcaaaaggaaaaactattatttttcctgaggaaggatttaaatggaatgaattggggcgtttagcacagaaattctaccgtgactatgaggatattacagagtacgaagttttattggcacggttaaaggaaaataagcagcaactcgtggctttgattgaacgattcagtaacgacgagctttacggtaaaccttggtataataaatggacccgaggtcgtatgattcaatttaataccgcctcgccttataaaaatgcttcggggaggttaaataaactgcagaaatgtcttgcagaa

SEQ ID NO: 4 - protein, 170 aa, Escherichia coli
MAVPSSKEELIKAINSNFSLLNKKLESITPQLAFEPLLEGHAKGTTISVANLVSYLIGWGELVLHWHDQEAKGKTIIFPEEGFKWNELGRLAQKFYRDYEDITEYEVLLARLKENKQQLVALIERFSNDELYGKPWYNKWTRGRMIQFNTASPYKNASGRLNKLQKCLAE

SEQ ID NO: 5 - DNA, 720 bp, Escherichia coli
  CDS (1)..(720): First CDS region
atgagtaatatcagtttgtattgtttgccatattcaggtggttctgccgccatgtattataaatggcgtagcgtgctgtcggacaatattactttgcggcctttagaacctgcggggaggggaactagaatacgccagccgctgtgtcttacgatggtggatgccgtcgctgacctttatcaacaatttgtgaaacactacacaggtggagactacgccatttttgggcatagtctcggagggatcatggccttcgaactggtgcattatattctcgatcatggacatgacatgccatgcgcgctgtttttttccggctgtcgcccacccgatcgggcctctcatgaagtaatactgcataccttgcccgatcaggcgtttatggaagagatcgtcaagctgggcggaactccggttgatgtctttcgtaataaagagttaatgacaattttcacccccatcattaaaaacgattatcggctctatgagcagtatgtatttcaggccaaggcgcgcacattaacctgtccgatcgtgctatttcatggcgatgctgacaatctggtaatgcaggatgaattacttgcatgggaaaaattcaccacacgaaagacgcggactattatatttcctgctgccgatcatttttttgtcgataagcattttgaacaggtggtaggttatgtgaaccagacgattgaatcactcgaaatagtaggg

SEQ ID NO: 6 - protein, 240 aa, Escherichia coli
MSNISLYCLPYSGGSAAMYYKWRSVLSDNITLRPLEPAGRGTRIRQPLCLTMVDAVADLYQQFVKHYTGGDYAIFGHSLGGIMAFELVHYILDHGHDMPCALFFSGCRPPDRASHEVILHTLPDQAFMEEIVKLGGTPVDVFRNKELMTIFTPIIKNDYRLYEQYVFQAKARTLTCPIVLFHGDADNLVMQDELLAWEKFTTRKTRTIIFPAADHFFVDKHFEQVVGYVNQTIESLEIVG

SEQ ID NO: 7 - DNA, 669 bp, Escherichia coli
  CDS (1)..(669): First CDS region
atgtattataaatggcgtagcgtgctgtcggacaatattactttgcggcctttagaacctgcggggaggggaactagaatacgccagccgctgtgtcttacgatggtggatgccgtcgctgacctttatcaacaatttgtgaaacactacacaggtggagactacgccatttttgggcatagtctcggagggatcatggccttcgaactggtgcattatattctcgatcatggacatgacatgccatgcgcgctgtttttttccggctgtcgcccacccgatcgggcctctcatgaagtaatactgcataccttgcccgatcaggcgtttatggaagagatcgtcaagctgggcggaactccggttgatgtctttcgtaataaagagttaatgacaattttcacccccatcattaaaaacgattatcggctctatgagcagtatgtatttcaggccaaggcgcgcacattaacctgtccgatcgtgctatttcatggcgatgctgacaatctggtaatgcaggatgaattacttgcatgggaaaaattcaccacacgaaagacgcggactattatatttcctgctgccgatcatttttttgtcgataagcattttgaacaggtggtaggttatgtgaaccagacgattgaatcactcgaaatagtaggg

SEQ ID NO: 8 - protein, 223 aa, Escherichia coli
MYYKWRSVLSDNITLRPLEPAGRGTRIRQPLCLTMVDAVADLYQQFVKHYTGGDYAIFGHSLGGIMAFELVHYILDHGHDMPCALFFSGCRPPDRASHEVILHTLPDQAFMEEIVKLGGTPVDVFRNKELMTIFTPIIKNDYRLYEQYVFQAKARTLTCPIVLFHGDADNLVMQDELLAWEKFTTRKTRTIIFPAADHFFVDKHFEQVVGYVNQTIESLEIVG

SEQ ID NO: 9 - DNA, 648 bp, Escherichia coli
  CDS (1)..(648): First CDS region
gtgctgtcggacaatattactttgcggcctttagaacctgcggggaggggaactagaatacgccagccgctgtgtcttacgatggtggatgccgtcgctgacctttatcaacaatttgtgaaacactacacaggtggagactacgccatttttgggcatagtctcggagggatcatggccttcgaactggtgcattatattctcgatcatggacatgacatgccatgcgcgctgtttttttccggctgtcgcccacccgatcgggcctctcatgaagtaatactgcataccttgcccgatcaggcgtttatggaagagatcgtcaagctgggcggaactccggttgatgtctttcgtaataaagagttaatgacaattttcacccccatcattaaaaacgattatcggctctatgagcagtatgtatttcaggccaaggcgcgcacattaacctgtccgatcgtgctatttcatggcgatgctgacaatctggtaatgcaggatgaattacttgcatgggaaaaattcaccacacgaaagacgcggactattatatttcctgctgccgatcatttttttgtcgataagcattttgaacaggtggtaggttatgtgaaccagacgattgaatcactcgaaatagtaggg

SEQ ID NO: 10 - protein, 216 aa, Escherichia coli
VLSDNITLRPLEPAGRGTRIRQPLCLTMVDAVADLYQQFVKHYTGGDYAIFGHSLGGIMAFELVHYILDHGHDMPCALFFSGCRPPDRASHEVILHTLPDQAFMEEIVKLGGTPVDVFRNKELMTIFTPIIKNDYRLYEQYVFQAKARTLTCPIVLFHGDADNLVMQDELLAWEKFTTRKTRTIIFPAADHFFVDKHFEQVVGYVNQTIESLEIVG

SEQ ID NO: 11 - DNA, 1512 bp, Escherichia coli
  CDS (1)..(1512): First CDS region
atgacaataatggaacacgttagcattaaaacattatatcatctcctgtgctgtatgctgctctttatttccgctatgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgag

SEQ ID NO: 12 - protein, 504 aa, Escherichia coli
MTIMEHVSIKTLYHLLCCMLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 13 - DNA, 1503 bp, Escherichia coli
  CDS (1)..(1503): First CDS region
atggaacacgttagcattaaaacattatatcatctcctgtgctgtatgctgctctttatttccgctatgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgag

SEQ ID NO: 14 - protein, 501 aa, Escherichia coli
MEHVSIKTLYHLLCCMLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 15 - DNA, 1458 bp, Escherichia coli
  CDS (1)..(1458): First CDS region
atgctgctctttatttccgctatgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgag

SEQ ID NO: 16 - protein, 486 aa, Escherichia coli
MLLFISAMCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 17 - DNA, 1437 bp, Escherichia coli
  CDS (1)..(1437): First CDS region
atgtgcgctttggcgcaagaacatgagcctatcggggcgcaagatgagcgcctgtcgacattaattcaccaacggatgcaggaggccaaggtcccagccctttccgtaagtgtgaccattaagggggtacgtcagcgatttgtctacggtgttgccgatgtggctagtcagaaagcgaatactctagacacagtttacgagctgggatcgatgagtaaggcgtttaccggacttgtggtgcaaatactgattcaggaaggcagactccggcaaggggatgatatcattacctatctgccggaaatgcgcttgaattatcagggaaaacctgcttccctgaccgtggctgatttcctttatcatacatcaggattgcctttttcaacactggctcggctggaaaaccctatgcctgggagcgctgtggcacagcaactgcgcaacgagaatctgctgtttgcgccgggtgcgaagtttagctatgcctccgccaattatgatgtgttgggcgcggtgattgaaaatgtgacgggaaaaacctttacagaggtcattgcggaacgactcacgcagccgctgggcatgtcggcgactgtggcagttaagggggatgagattattgtcaacaaggcaagcggctataaactgggattcggcaaacccgttctgtttcatgcgcctctggcccggaaccatgttcctgccgcctatatccatagcactctgcctgatatggaaatatggatagacgcctggttgcacagaaaggctttgccggcaacgctgcgtgaggcgatgagtaacagttggcgtggtaatagtgatgttccgcttgccgcagacaatcgtatcctctatgccagcggttggtttatcgaccagaatcaaggcccttacatcagtcacggtgggcagaatccaaacttttcttcttgcattgcgttgcgaccggatcagcagattggcattgttgcgctggcaaatatgaattcgaatctgatactacagctttgcgcggatatcgataattatctgcgcattggcaaatatgctgacggcgctggtgatgcaattacagccaccgatacccttttcgtctacctcacgttgttgctgtgtttttggggggcggtggttgtagtgcgcggtgctttccgtgtttatcgcgcaacggcgcatggccctggaaaacagcagaggttacgtttacgcgtacgtgactatatcatcgccttggcggttcctgggctcgtggccgccatgctctatgtcgcaccgggtatactatctccaggacttgactggcgttttatcttggtatggggtccatcgagcgtgttggcgataccgttcggaattatcctgttagctttcgttctgacattaaatcatcaaattaaacgaattctattacacaacaaggagtgggacgatgag

SEQ ID NO: 18 - protein, 479 aa, Escherichia coli
MCALAQEHEPIGAQDERLSTLIHQRMQEAKVPALSVSVTIKGVRQRFVYGVADVASQKANTLDTVYELGSMSKAFTGLVVQILIQEGRLRQGDDIITYLPEMRLNYQGKPASLTVADFLYHTSGLPFSTLARLENPMPGSAVAQQLRNENLLFAPGAKFSYASANYDVLGAVIENVTGKTFTEVIAERLTQPLGMSATVAVKGDEIIVNKASGYKLGFGKPVLFHAPLARNHVPAAYIHSTLPDMEIWIDAWLHRKALPATLREAMSNSWRGNSDVPLAADNRILYASGWFIDQNQGPYISHGGQNPNFSSCIALRPDQQIGIVALANMNSNLILQLCADIDNYLRIGKYADGAGDAITATDTLFVYLTLLLCFWGAVVVVRGAFRVYRATAHGPGKQQRLRLRVRDYIIALAVPGLVAAMLYVAPGILSPGLDWRFILVWGPSSVLAIPFGIILLAFVLTLNHQIKRILLHNKEWDDE

SEQ ID NO: 19 - DNA, 2457 bp, Escherichia coli
  CDS (1)..(2457): First CDS region
atggcaaaggatgattttacctgtggctcactggatattgccattattggcatgagcgggcgtttttccggtgcggaatcggtgcccgagtggtgggataagttgctggcgggtgaggagttcactcaaccgacatgcacagaagacgataatgggaacccttggattaggctgcgcaatataatcaccgctccctatgacttcgatgctgcatttttcaatattccgcctggcgaagccctgttgatggatccgcaacaacgaatatttcttgaatgctgctacaacgctcttgagcatgcgggctatattcccacgcaacttaagcgagtcggcgtctatggggcgacctacgccaataactattttatcgatcgcgtctatccatacctgaagatgagcggcgatcaccattatcttcaggcgcagattggtaacgaaaaggattacttgtgtgctcaggttgcctacaagttggggtttaccggacccgctgtgagtgtacagaccgcctgttccagttcgttggtggcagcatatttagcatgcgaggggttattgacttttcaagccgatgttgcgttggcaggtggggtcaccttgggttttttacaggcgcacggctacagtccgcaaggtgataagctggtatcgcaagacggacactgcgccccgtttagcgctgaggcgaccggcacggtatacagcagcggtgcgggagttgtggtgctaaaacgtcttgaggatgcactacgcgaccaagacagagtgtatgcggtgattaaaggaggtgcggtaaataacgacggcgggcgtcggctggggtttgtcgcccccagcgtagaaggacaggtagaagcgatcaatacggcgcttgccgccgcagaagtcgtaccgactgatatcgcactgatcgaaacgcacggtaccggtaccccgttgggtgatgagattgagcttgaagctctgcaccgggttttcgcaccggcatgtgcgccgcacagcattcaattgggtgcggtaaaagccaacttgggtcacctgggagtcgcttccggtatcgtcagcttaatgaaaaccgcactgacgctatatactggtttagttcccccgcagatcaacctagtaaataaacataaaaaactgttgcagccagcctcgccattttatctcagtgatgtagtgacttctgtcccacaaacgaaaaggatccatgccaccgttagttcgtttgggctgggagggaccaatgctcatttggttctgcaaaactggtgcgagacgcctgcgcaagcggtgcaagaaaatgagcgccgcctgtttttcttcagcgccaaaacgccattagcccttagacaacagttggatgctcattatcacgctctggcgacctatgcggaagcagataaagatcgtatcgcctatactctcgcgcaacgccgggcacatttcccgtatcgctgtgcgctggcggcagacagtgtggtagcgttgcgtgcaagtttggcgaaactgcgggatgctgacatgtcttttacccctatcaatatggaaactaccttggtgttcctatatccggaccgggacgataagctggagagtgccctgacgcatttgctggcttgtcaacctaacttgcgccagcggcaccagcgcctgtctcaggatgttgcacaaatctgcgaaccagccgattggacgccagcattgcgtcagtttatccagcaggtgagtcttagtgaatggctgatcgaacaaagtatctcgcctgtgcagcacatcggttacctgacgggggctgcagcagcgcagtatgttgcgcgcatcatctcactggaaaacgctgttcagcaggtgattgtggctgaaacgacaccggagcagacgctggccggcaacagtgaactgagcgaaatattggctaatctggcggtgacggagggaacgctgatgctggaaatcggtcgcgcggggacgttttccatattgtatcaccagcatgcgcagtgggttgggcaaacagtattttcccccatgctgaatacggatacgcctgaggacatcctgccgctgttgggcactctttggcaacgaggagtgactatttgtttaccggaaatgccagccgtgcagactataggcttacccggttattcgtttgatcgcgtccggtatgaaattcagtccagtgatgcgagagagaacgctatgttaccagtgagttatttgtcggtcagcgactttgtggagaaaacctggcgttcattgttatgcatcgatcattatgacgaacacgcggttattttcgaatacggagcgacctcgatgcacgttatctctttcgtcgacagctgtaaccacatttataaaatcggactgactgccgccgatatttatgccagacccgctatccgtgagcacagtgaatttatctccgaatgtgttgatggtatttta

SEQ ID NO: 20 - protein, 819 aa, Escherichia coli
MAKDDFTCGSLDIAIIGMSGRFSGAESVPEWWDKLLAGEEFTQPTCTEDDNGNPWIRLRNIITAPYDFDAAFFNIPPGEALLMDPQQRIFLECCYNALEHAGYIPTQLKRVGVYGATYANNYFIDRVYPYLKMSGDHHYLQAQIGNEKDYLCAQVAYKLGFTGPAVSVQTACSSSLVAAYLACEGLLTFQADVALAGGVTLGFLQAHGYSPQGDKLVSQDGHCAPFSAEATGTVYSSGAGVVVLKRLEDALRDQDRVYAVIKGGAVNNDGGRRLGFVAPSVEGQVEAINTALAAAEVVPTDIALIETHGTGTPLGDEIELEALHRVFAPACAPHSIQLGAVKANLGHLGVASGIVSLMKTALTLYTGLVPPQINLVNKHKKLLQPASPFYLSDVVTSVPQTKRIHATVSSFGLGGTNAHLVLQNWCETPAQAVQENERRLFFFSAKTPLALRQQLDAHYHALATYAEADKDRIAYTLAQRRAHFPYRCALAADSVVALRASLAKLRDADMSFTPINMETTLVFLYPDRDDKLESALTHLLACQPNLRQRHQRLSQDVAQICEPADWTPALRQFIQQVSLSEWLIEQSISPVQHIGYLTGAAAAQYVARIISLENAVQQVIVAETTPEQTLAGNSELSEILANLAVTEGTLMLEIGRAGTFSILYHQHAQWVGQTVFSPMLNTDTPEDILPLLGTLWQRGVTICLPEMPAVQTIGLPGYSFDRVRYEIQSSDARENAMLPVSYLSVSDFVEKTWRSLLCIDHYDEHAVIFEYGATSMHVISFVDSCNHIYKIGLTAADIYARPAIREHSEFISECVDGIL

SEQ ID NO: 21 - DNA, 2406 bp, Escherichia coli
  CDS (1)..(2406): First CDS region
atgagcgggcgtttttccggtgcggaatcggtgcccgagtggtgggataagttgctggcgggtgaggagttcactcaaccgacatgcacagaagacgataatgggaacccttggattaggctgcgcaatataatcaccgctccctatgacttcgatgctgcatttttcaatattccgcctggcgaagccctgttgatggatccgcaacaacgaatatttcttgaatgctgctacaacgctcttgagcatgcgggctatattcccacgcaacttaagcgagtcggcgtctatggggcgacctacgccaataactattttatcgatcgcgtctatccatacctgaagatgagcggcgatcaccattatcttcaggcgcagattggtaacgaaaaggattacttgtgtgctcaggttgcctacaagttggggtttaccggacccgctgtgagtgtacagaccgcctgttccagttcgttggtggcagcatatttagcatgcgaggggttattgacttttcaagccgatgttgcgttggcaggtggggtcaccttgggttttttacaggcgcacggctacagtccgcaaggtgataagctggtatcgcaagacggacactgcgccccgtttagcgctgaggcgaccggcacggtatacagcagcggtgcgggagttgtggtgctaaaacgtcttgaggatgcactacgcgaccaagacagagtgtatgcggtgattaaaggaggtgcggtaaataacgacggcgggcgtcggctggggtttgtcgcccccagcgtagaaggacaggtagaagcgatcaatacggcgcttgccgccgcagaagtcgtaccgactgatatcgcactgatcgaaacgcacggtaccggtaccccgttgggtgatgagattgagcttgaagctctgcaccgggttttcgcaccggcatgtgcgccgcacagcattcaattgggtgcggtaaaagccaacttgggtcacctgggagtcgcttccggtatcgtcagcttaatgaaaaccgcactgacgctatatactggtttagttcccccgcagatcaacctagtaaataaacataaaaaactgttgcagccagcctcgccattttatctcagtgatgtagtgacttctgtcccacaaacgaaaaggatccatgccaccgttagttcgtttgggctgggagggaccaatgctcatttggttctgcaaaactggtgcgagacgcctgcgcaagcggtgcaagaaaatgagcgccgcctgtttttcttcagcgccaaaacgccattagcccttagacaacagttggatgctcattatcacgctctggcgacctatgcggaagcagataaagatcgtatcgcctatactctcgcgcaacgccgggcacatttcccgtatcgctgtgcgctggcggcagacagtgtggtagcgttgcgtgcaagtttggcgaaactgcgggatgctgacatgtcttttacccctatcaatatggaaactaccttggtgttcctatatccggaccgggacgataagctggagagtgccctgacgcatttgctggcttgtcaacctaacttgcgccagcggcaccagcgcctgtctcaggatgttgcacaaatctgcgaaccagccgattggacgccagcattgcgtcagtttatccagcaggtgagtcttagtgaatggctgatcgaacaaagtatctcgcctgtgcagcacatcggttacctgacgggggctgcagcagcgcagtatgttgcgcgcatcatctcactggaaaacgctgttcagcaggtgattgtggctgaaacgacaccggagcagacgctggccggcaacagtgaactgagcgaaatattggctaatctggcggtgacggagggaacgctgatgctggaaatcggtcgcgcggggacgttttccatattgtatcaccagcatgcgcagtgggttgggcaaacagtattttcccccatgctgaatacggatacgcctgaggacatcctgccgctgttgggcactctttggcaacgaggagtgactatttgtttaccggaaatgccagccgtgcagactataggcttacccggttattcgtttgatcgcgtccggtatgaaattcagtccagtgatgcgagagagaacgctatgttaccagtgagttatttgtcggtcagcgactttgtggagaaaacctggcgttcattgttatgcatcgatcattatgacgaacacgcggttattttcgaatacggagcgacctcgatgcacgttatctctttcgtcgacagctgtaaccacatttataaaatcggactgactgccgccgatatttatgccagacccgctatccgtgagcacagtgaatttatctccgaatgtgttgatggtatttta

SEQ ID NO: 22 - protein, 802 aa, Escherichia coli
MSGRFSGAESVPEWWDKLLAGEEFTQPTCTEDDNGNPWIRLRNIITAPYDFDAAFFNIPPGEALLMDPQQRIFLECCYNALEHAGYIPTQLKRVGVYGATYANNYFIDRVYPYLKMSGDHHYLQAQIGNEKDYLCAQVAYKLGFTGPAVSVQTACSSSLVAAYLACEGLLTFQADVALAGGVTLGFLQAHGYSPQGDKLVSQDGHCAPFSAEATGTVYSSGAGVVVLKRLEDALRDQDRVYAVIKGGAVNNDGGRRLGFVAPSVEGQVEAINTALAAAEVVPTDIALIETHGTGTPLGDEIELEALHRVFAPACAPHSIQLGAVKANLGHLGVASGIVSLMKTALTLYTGLVPPQINLVNKHKKLLQPASPFYLSDVVTSVPQTKRIHATVSSFGLGGTNAHLVLQNWCETPAQAVQENERRLFFFSAKTPLALRQQLDAHYHALATYAEADKDRIAYTLAQRRAHFPYRCALAADSVVALRASLAKLRDADMSFTPINMETTLVFLYPDRDDKLESALTHLLACQPNLRQRHQRLSQDVAQICEPADWTPALRQFIQQVSLSEWLIEQSISPVQHIGYLTGAAAAQYVARIISLENAVQQVIVAETTPEQTLAGNSELSEILANLAVTEGTLMLEIGRAGTFSILYHQHAQWVGQTVFSPMLNTDTPEDILPLLGTLWQRGVTICLPEMPAVQTIGLPGYSFDRVRYEIQSSDARENAMLPVSYLSVSDFVEKTWRSLLCIDHYDEHAVIFEYGATSMHVISFVDSCNHIYKIGLTAADIYARPAIREHSEFISECVDGIL

SEQ ID NO: 23 - DNA, 2376 bp, Escherichia coli
  CDS (1)..(2376): First CDS region
gtgcccgagtggtgggataagttgctggcgggtgaggagttcactcaaccgacatgcacagaagacgataatgggaacccttggattaggctgcgcaatataatcaccgctccctatgacttcgatgctgcatttttcaatattccgcctggcgaagccctgttgatggatccgcaacaacgaatatttcttgaatgctgctacaacgctcttgagcatgcgggctatattcccacgcaacttaagcgagtcggcgtctatggggcgacctacgccaataactattttatcgatcgcgtctatccatacctgaagatgagcggcgatcaccattatcttcaggcgcagattggtaacgaaaaggattacttgtgtgctcaggttgcctacaagttggggtttaccggacccgctgtgagtgtacagaccgcctgttccagttcgttggtggcagcatatttagcatgcgaggggttattgacttttcaagccgatgttgcgttggcaggtggggtcaccttgggttttttacaggcgcacggctacagtccgcaaggtgataagctggtatcgcaagacggacactgcgccccgtttagcgctgaggcgaccggcacggtatacagcagcggtgcgggagttgtggtgctaaaacgtcttgaggatgcactacgcgaccaagacagagtgtatgcggtgattaaaggaggtgcggtaaataacgacggcgggcgtcggctggggtttgtcgcccccagcgtagaaggacaggtagaagcgatcaatacggcgcttgccgccgcagaagtcgtaccgactgatatcgcactgatcgaaacgcacggtaccggtaccccgttgggtgatgagattgagcttgaagctctgcaccgggttttcgcaccggcatgtgcgccgcacagcattcaattgggtgcggtaaaagccaacttgggtcacctgggagtcgcttccggtatcgtcagcttaatgaaaaccgcactgacgctatatactggtttagttcccccgcagatcaacctagtaaataaacataaaaaactgttgcagccagcctcgccattttatctcagtgatgtagtgacttctgtcccacaaacgaaaaggatccatgccaccgttagttcgtttgggctgggagggaccaatgctcatttggttctgcaaaactggtgcgagacgcctgcgcaagcggtgcaagaaaatgagcgccgcctgtttttcttcagcgccaaaacgccattagcccttagacaacagttggatgctcattatcacgctctggcgacctatgcggaagcagataaagatcgtatcgcctatactctcgcgcaacgccgggcacatttcccgtatcgctgtgcgctggcggcagacagtgtggtagcgttgcgtgcaagtttggcgaaactgcgggatgctgacatgtcttttacccctatcaatatggaaactaccttggtgttcctatatccggaccgggacgataagctggagagtgccctgacgcatttgctggcttgtcaacctaacttgcgccagcggcaccagcgcctgtctcaggatgttgcacaaatctgcgaaccagccgattggacgccagcattgcgtcagtttatccagcaggtgagtcttagtgaatggctgatcgaacaaagtatctcgcctgtgcagcacatcggttacctgacgggggctgcagcagcgcagtatgttgcgcgcatcatctcactggaaaacgctgttcagcaggtgattgtggctgaaacgacaccggagcagacgctggccggcaacagtgaactgagcgaaatattggctaatctggcggtgacggagggaacgctgatgctggaaatcggtcgcgcggggacgttttccatattgtatcaccagcatgcgcagtgggttgggcaaacagtattttcccccatgctgaatacggatacgcctgaggacatcctgccgctgttgggcactctttggcaacgaggagtgactatttgtttaccggaaatgccagccgtgcagactataggcttacccggttattcgtttgatcgcgtccggtatgaaattcagtccagtgatgcgagagagaacgctatgttaccagtgagttatttgtcggtcagcgactttgtggagaaaacctggcgttcattgttatgcatcgatcattatgacgaacacgcggttattttcgaatacggagcgacctcgatgcacgttatctctttcgtcgacagctgtaaccacatttataaaatcggactgactgccgccgatatttatgccagacccgctatccgtgagcacagtgaatttatctccgaatgtgttgatggtatttta

SEQ ID NO: 24 - protein, 792 aa, Escherichia coli
VPEWWDKLLAGEEFTQPTCTEDDNGNPWIRLRNIITAPYDFDAAFFNIPPGEALLMDPQQRIFLECCYNALEHAGYIPTQLKRVGVYGATYANNYFIDRVYPYLKMSGDHHYLQAQIGNEKDYLCAQVAYKLGFTGPAVSVQTACSSSLVAAYLACEGLLTFQADVALAGGVTLGFLQAHGYSPQGDKLVSQDGHCAPFSAEATGTVYSSGAGVVVLKRLEDALRDQDRVYAVIKGGAVNNDGGRRLGFVAPSVEGQVEAINTALAAAEVVPTDIALIETHGTGTPLGDEIELEALHRVFAPACAPHSIQLGAVKANLGHLGVASGIVSLMKTALTLYTGLVPPQINLVNKHKKLLQPASPFYLSDVVTSVPQTKRIHATVSSFGLGGTNAHLVLQNWCETPAQAVQENERRLFFFSAKTPLALRQQLDAHYHALATYAEADKDRIAYTLAQRRAHFPYRCALAADSVVALRASLAKLRDADMSFTPINMETTLVFLYPDRDDKLESALTHLLACQPNLRQRHQRLSQDVAQICEPADWTPALRQFIQQVSLSEWLIEQSISPVQHIGYLTGAAAAQYVARIISLENAVQQVIVAETTPEQTLAGNSELSEILANLAVTEGTLMLEIGRAGTFSILYHQHAQWVGQTVFSPMLNTDTPEDILPLLGTLWQRGVTICLPEMPAVQTIGLPGYSFDRVRYEIQSSDARENAMLPVSYLSVSDFVEKTWRSLLCIDHYDEHAVIFEYGATSMHVISFVDSCNHIYKIGLTAADIYARPAIREHSEFISECVDGIL

SEQ ID NO: 25 - DNA, 2211 bp, Escherichia coli
  CDS (1)..(2211): First CDS region
atggatccgcaacaacgaatatttcttgaatgctgctacaacgctcttgagcatgcgggctatattcccacgcaacttaagcgagtcggcgtctatggggcgacctacgccaataactattttatcgatcgcgtctatccatacctgaagatgagcggcgatcaccattatcttcaggcgcagattggtaacgaaaaggattacttgtgtgctcaggttgcctacaagttggggtttaccggacccgctgtgagtgtacagaccgcctgttccagttcgttggtggcagcatatttagcatgcgaggggttattgacttttcaagccgatgttgcgttggcaggtggggtcaccttgggttttttacaggcgcacggctacagtccgcaaggtgataagctggtatcgcaagacggacactgcgccccgtttagcgctgaggcgaccggcacggtatacagcagcggtgcgggagttgtggtgctaaaacgtcttgaggatgcactacgcgaccaagacagagtgtatgcggtgattaaaggaggtgcggtaaataacgacggcgggcgtcggctggggtttgtcgcccccagcgtagaaggacaggtagaagcgatcaatacggcgcttgccgccgcagaagtcgtaccgactgatatcgcactgatcgaaacgcacggtaccggtaccccgttgggtgatgagattgagcttgaagctctgcaccgggttttcgcaccggcatgtgcgccgcacagcattcaattgggtgcggtaaaagccaacttgggtcacctgggagtcgcttccggtatcgtcagcttaatgaaaaccgcactgacgctatatactggtttagttcccccgcagatcaacctagtaaataaacataaaaaactgttgcagccagcctcgccattttatctcagtgatgtagtgacttctgtcccacaaacgaaaaggatccatgccaccgttagttcgtttgggctgggagggaccaatgctcatttggttctgcaaaactggtgcgagacgcctgcgcaagcggtgcaagaaaatgagcgccgcctgtttttcttcagcgccaaaacgccattagcccttagacaacagttggatgctcattatcacgctctggcgacctatgcggaagcagataaagatcgtatcgcctatactctcgcgcaacgccgggcacatttcccgtatcgctgtgcgctggcggcagacagtgtggtagcgttgcgtgcaagtttggcgaaactgcgggatgctgacatgtcttttacccctatcaatatggaaactaccttggtgttcctatatccggaccgggacgataagctggagagtgccctgacgcatttgctggcttgtcaacctaacttgcgccagcggcaccagcgcctgtctcaggatgttgcacaaatctgcgaaccagccgattggacgccagcattgcgtcagtttatccagcaggtgagtcttagtgaatggctgatcgaacaaagtatctcgcctgtgcagcacatcggttacctgacgggggctgcagcagcgcagtatgttgcgcgcatcatctcactggaaaacgctgttcagcaggtgattgtggctgaaacgacaccggagcagacgctggccggcaacagtgaactgagcgaaatattggctaatctggcggtgacggagggaacgctgatgctggaaatcggtcgcgcggggacgttttccatattgtatcaccagcatgcgcagtgggttgggcaaacagtattttcccccatgctgaatacggatacgcctgaggacatcctgccgctgttgggcactctttggcaacgaggagtgactatttgtttaccggaaatgccagccgtgcagactataggcttacccggttattcgtttgatcgcgtccggtatgaaattcagtccagtgatgcgagagagaacgctatgttaccagtgagttatttgtcggtcagcgactttgtggagaaaacctggcgttcattgttatgcatcgatcattatgacgaacacgcggttattttcgaatacggagcgacctcgatgcacgttatctctttcgtcgacagctgtaaccacatttataaaatcggactgactgccgccgatatttatgccagacccgctatccgtgagcacagtgaatttatctccgaatgtgttgatggtatttta

SEQ ID NO: 26 - protein, 737 aa, Escherichia coli
MDPQQRIFLECCYNALEHAGYIPTQLKRVGVYGATYANNYFIDRVYPYLKMSGDHHYLQAQIGNEKDYLCAQVAYKLGFTGPAVSVQTACSSSLVAAYLACEGLLTFQADVALAGGVTLGFLQAHGYSPQGDKLVSQDGHCAPFSAEATGTVYSSGAGVVVLKRLEDALRDQDRVYAVIKGGAVNNDGGRRLGFVAPSVEGQVEAINTALAAAEVVPTDIALIETHGTGTPLGDEIELEALHRVFAPACAPHSIQLGAVKANLGHLGVASGIVSLMKTALTLYTGLVPPQINLVNKHKKLLQPASPFYLSDVVTSVPQTKRIHATVSSFGLGGTNAHLVLQNWCETPAQAVQENERRLFFFSAKTPLALRQQLDAHYHALATYAEADKDRIAYTLAQRRAHFPYRCALAADSVVALRASLAKLRDADMSFTPINMETTLVFLYPDRDDKLESALTHLLACQPNLRQRHQRLSQDVAQICEPADWTPALRQFIQQVSLSEWLIEQSISPVQHIGYLTGAAAAQYVARIISLENAVQQVIVAETTPEQTLAGNSELSEILANLAVTEGTLMLEIGRAGTFSILYHQHAQWVGQTVFSPMLNTDTPEDILPLLGTLWQRGVTICLPEMPAVQTIGLPGYSFDRVRYEIQSSDARENAMLPVSYLSVSDFVEKTWRSLLCIDHYDEHAVIFEYGATSMHVISFVDSCNHIYKIGLTAADIYARPAIREHSEFISECVDGIL

SEQ ID NO: 27 - DNA, 4365 bp, Escherichia coli
  CDS (1)..(4365): First CDS region
atgatgtcgggcaatccgttgtcgtggccacaggaacagtgccacatcattgatcaactgtatccttacagtgccgtaaacatcattggtggtgtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctatcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 28 - protein, 1455 aa, Escherichia coli
MMSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 29 - DNA, 4362 bp, Escherichia coli
  CDS (1)..(4362): First CDS region
atgtcgggcaatccgttgtcgtggccacaggaacagtgccacatcattgatcaactgtatccttacagtgccgtaaacatcattggtggtgtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctatcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 30 - protein, 1454 aa, Escherichia coli
MSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 31 - DNA, 4272 bp, Escherichia coli
  CDS (1)..(4272): First CDS region
gtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctatcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 32 - protein, 1424 aa, Escherichia coli
VVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 33 - DNA, 4188 bp, Escherichia coli
  CDS (1)..(4188): First CDS region
atgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctatcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 34 - protein, 1396 aa, Escherichia coli
MWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 35 - DNA, 4452 bp, Escherichia coli
  CDS (1)..(4452): First CDS region
gtggcgtctgctgcgtctttcacctcgtctgctgcgatggaatcaggaggcggtgcgctcccaacacttggatatggaggtggcaccatgatgtcgggcaatccgttgtcgtggccacaggaacagtgccacatcattgatcaactgtatccttacagtgccgtaaacatcattggtggtgtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctgtcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 36 - protein, 1484 aa, Escherichia coli
VASAASFTSSAAMESGGGALPTLGYGGGTMMSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 37 - DNA, 4416 bp, Escherichia coli
  CDS (1)..(4416): First CDS region
atggaatcaggaggcggtgcgctcccaacacttggatatggaggtggcaccatgatgtcgggcaatccgttgtcgtggccacaggaacagtgccacatcattgatcaactgtatccttacagtgccgtaaacatcattggtggtgtggtcaccattgagggaattgtcgatctgccccgactacacgcggccatccagtccgccattcggcaatttgatgcgttgcgtatgtggtttgtgatgggagaggagagtgaagtggtcagccaagtgcagccttatcactggcgcgatatccgccatttgactttttccccagattatgacaaggagaacctacgcccagcggcgatcgaaacatttgttgatgagtggttccggcagccctttaccctgctggcgcacgatttgttcgagtttgtcacctttacgtgcggtgaacaatacagcggttatttatttaaagcccatcacggcattgctgatggttggtcaatggcgttgttgtcaaaccatgtcaagcgagcatacgaacagcaggacgtaccagatgatgcgtcaccagcctatagcgcatttctggcgcagcagcaatcttatcaggcgtcaacgcgctttgccgttgatcgtggctggtggcgtgactatatcgacgaataccgcgactgctttccagacagttcccccatcgttactactgagggcatcagttgttccacttggcttgagccagccatgattaaccgtctctacaggttgtgtaatcgttatggctgtacgcttaatacgctgtttattgcactcttcgctctctatcgcgccagagtatggggggaggaaaaaggcgtaataggcgtgccgttagccaatcggcatactcgcgaggcgcggcgttgctttggcatgtttactaatcaattgccgctggcctatcgactggtgcgcacggaacgattctgtgaacgggtggcctttttccagcgcgaactgaaacgcggttttaaacacagcaaatatcccattaccttattcaaccaggatttggcggaacaggggggagggaagttgcgggcgttcgattattgcgttaattattataactttacctatgaacgccacattgcaggtgccgcgcaacgcgtggagagttactacagcggcgagcagtcctataagctacagattgttttgcaaactgttaataatcataaagaaagccttaggttgagtctggaggcgctgcgtagcgctttcactccgcaccaactgacagcgatgaaaaatgggctgttggatttagtcactgcattggatcggcaacctgacgctcgtctaggcgatctcgaagtctatcctgcgccgcacgtcgcattggcatgtggctcactcaaaccctcatttacttcccgatttgcagcgcaagttgtggagcatggtgatcgcacagcactaattgataatgaacagtctttgacttatcggcagttggatgacgctgttgagcgggttgcgcgttatctgcgccaacaggggatcggacgcggtcaagtggttgggattatcgctgagcatagcgctcaaacggtgatggttatttatggtattttgcgctgcggcgcggcatttctgccgctaaatcccgcgttgccaacgacccgcctttacgccatgtgtcgtaaagcgcaggtagcgcatatcctttacgatccggcgatgcatgaattgacgcaggcgctggcgtttcccgcgtccagcttgctccaggccttagccacttcggcgcttgctagagaaccttggccagctattgaaccgcaggatctggcatatgtgctgtttacctccggatcgaccggcgagcctaagggcgtgcaagtctctcatggcaatctggctaactatctccatttcgccgccgaacgttactttacagcgcaggaccgggctgcgctctactcttcgctgtccttcgatttgaccatcactacgctgttcgcccccttatgtgtgggcgctagcatcagcgtttgtcggcacgccgagagcgaaacattgctgcgcatggccgtggttgatcagcccaacacagtgatcaaactgacgcctgcacacctgcggttgttgtgtgcggctggcataagcagtgagcagattcgtaccttggtggttggcggggaggatttcaagcgggatctggcgcgtaaggcggctgctctctttcctcaggccgtgatctataacgaatatgggccgacagaggccaccgttggttgcatgatctatcgctacaccgggcaagaaacgctgccttcattgcccatcggtatggcgatcgacggttgccaggtagcaatttgctccccttggggctgtccggtaccggaaggcgaaactggtgaattggtgatttatggcgcgtcagtgacgcagggctatatcgatgcgccgcaacaaacggccgccgcctaccttaaagataccaatggggtgatgattggctatcgcagcggtgatattggctacgccatcgctcctaatacgctggtttatcagggacgtaaagacgatcaggtcaaaattaatggctatcgtattgagctgtgcgaaatcgaacaagcgttgttgagcgcacctcaggtagaaagtgcggcggtggcggtgattgatgatgtgcaggggcagcacagcgggttgctagcctgcgtgacaccgtcatctgttgatgtagctaccgtaatgcaacatctgcgtcagcaattacccacctacatgcaacccaagcagtgctgtgctatcgcccaactgccgctgtcgcacaatggcaaggtggacgtgcgtcagatggtcgcaacggtccgaaacaccgcgcctgcatcgggtagcgagcggctgggagatgcggcgataaggcattcagttcgggtatgtgtggaaggggcgctggagcaaactgagtttgatgataacgaaaatctttatgtcttggggttggactccatcaagagtatccagattgcagcgcagctcaggcaccacggctggacgatgtcagcggtgcaggtgatggagtgtggaacagtgaacgccatctgtgagtttctcgctagtcatacaacggtgtcacagctcgcgcagtatgctcataacacccgtatcgatctacccgcattgcgttggtttacgcagttggcgttgccagtgcccaatgtttataaccatgtcattgtgctgaaagtgttgccgggctgcccgctcgagcagttacacaacaggctgcatacattaatccagcagcagccagctttgcacagtgcgctggacgctgaggggcggttgctagtatgcgaccctaatgtgtgttatcccaacgaggtgctcacggaatattcgacggcgcagtggacgttggcagaggtgatcgctcagtgcaatagcatgcttgacgtgacaaatggtcgagtctttacggcagctctgttacacgccccgcagcctgcgtctagcacgctggtactctgtgcccatcacttgtgcgtcgatatgcactcttggtatttaatcctcagcacgctggacgccgtcagcactgtcaatggcaccagcaacagcggactgcatcgctggaatgactatctggcgagcaaaacggtagattccgccacacacgaaagctggcgcacagtatgtcaaacgctaccgctgcatttcccacccgtgtcattgccagatgactcattacctcgtacgcgcgcttggcgtgaagactttcgccatccttgcgtcaggaggttgtttgaatccagtggtaataccgcgtacagcgccgaaacctatgtgctaacggcattggcgctggtgctgcgttactacagcgaagagccttggtgtcgcatcgagatggaaggcatgggacgcggctgctggcccgatgagcctgacgttgcggatacggtcgggtggtttactctattttatccttgggcgatccctctgcatggcgatatggcgacactgttatctgcgatcgcttccgatttggcaaaacgcacgcatggtgggggagattacggtctgctgcaaatgcggcatgcaccggaagactctcttgcgcaagggatccgaatgaattacatcggtgtgcaggcgcaaccttcactccgctattttcatattgatcactttaatagtgatatctataccgcgcctgaaaacgcgctcggctgcgtgctggagtttaatattgcgcgctcggcagctgatggtctctccttccactgccgtttcgatcccacgcgcattgcgctgaatgatgtgcaactcctgctggcgcgctacaagaacagcctcactgatctggatgcctggctgtgccaacacagcgccacgctgacgggcgcgccgactttgtggacacta

SEQ ID NO: 38 - protein, 1472 aa, Escherichia coli
MESGGGALPTLGYGGGTMMSGNPLSWPQEQCHIIDQLYPYSAVNIIGGVVTIEGIVDLPRLHAAIQSAIRQFDALRMWFVMGEESEVVSQVQPYHWRDIRHLTFSPDYDKENLRPAAIETFVDEWFRQPFTLLAHDLFEFVTFTCGEQYSGYLFKAHHGIADGWSMALLSNHVKRAYEQQDVPDDASPAYSAFLAQQQSYQASTRFAVDRGWWRDYIDEYRDCFPDSSPIVTTEGISCSTWLEPAMINRLYRLCNRYGCTLNTLFIALFALYRARVWGEEKGVIGVPLANRHTREARRCFGMFTNQLPLAYRLVRTERFCERVAFFQRELKRGFKHSKYPITLFNQDLAEQGGGKLRAFDYCVNYYNFTYERHIAGAAQRVESYYSGEQSYKLQIVLQTVNNHKESLRLSLEALRSAFTPHQLTAMKNGLLDLVTALDRQPDARLGDLEVYPAPHVALACGSLKPSFTSRFAAQVVEHGDRTALIDNEQSLTYRQLDDAVERVARYLRQQGIGRGQVVGIIAEHSAQTVMVIYGILRCGAAFLPLNPALPTTRLYAMCRKAQVAHILYDPAMHELTQALAFPASSLLQALATSALAREPWPAIEPQDLAYVLFTSGSTGEPKGVQVSHGNLANYLHFAAERYFTAQDRAALYSSLSFDLTITTLFAPLCVGASISVCRHAESETLLRMAVVDQPNTVIKLTPAHLRLLCAAGISSEQIRTLVVGGEDFKRDLARKAAALFPQAVIYNEYGPTEATVGCMIYRYTGQETLPSLPIGMAIDGCQVAICSPWGCPVPEGETGELVIYGASVTQGYIDAPQQTAAAYLKDTNGVMIGYRSGDIGYAIAPNTLVYQGRKDDQVKINGYRIELCEIEQALLSAPQVESAAVAVIDDVQGQHSGLLACVTPSSVDVATVMQHLRQQLPTYMQPKQCCAIAQLPLSHNGKVDVRQMVATVRNTAPASGSERLGDAAIRHSVRVCVEGALEQTEFDDNENLYVLGLDSIKSIQIAAQLRHHGWTMSAVQVMECGTVNAICEFLASHTTVSQLAQYAHNTRIDLPALRWFTQLALPVPNVYNHVIVLKVLPGCPLEQLHNRLHTLIQQQPALHSALDAEGRLLVCDPNVCYPNEVLTEYSTAQWTLAEVIAQCNSMLDVTNGRVFTAALLHAPQPASSTLVLCAHHLCVDMHSWYLILSTLDAVSTVNGTSNSGLHRWNDYLASKTVDSATHESWRTVCQTLPLHFPPVSLPDDSLPRTRAWREDFRHPCVRRLFESSGNTAYSAETYVLTALALVLRYYSEEPWCRIEMEGMGRGCWPDEPDVADTVGWFTLFYPWAIPLHGDMATLLSAIASDLAKRTHGGGDYGLLQMRHAPEDSLAQGIRMNYIGVQAQPSLRYFHIDHFNSDIYTAPENALGCVLEFNIARSAADGLSFHCRFDPTRIALNDVQLLLARYKNSLTDLDAWLCQHSATLTGAPTLWTL

SEQ ID NO: 39 - DNA, 1437 bp, Escherichia coli
  CDS (1)..(1437): First CDS region
atgacggtgaataagcttgagccagacaacggcacgccgaacgatgagctgttcacggtggcgggtatgtttgacggctcgctgtataaattactcctgcgcatggcgttgccgatgtttgtcggtatgttaacgcaggtgacctatgccatcgccgatattttttggctgagccacattgatgtcaccaacagcggcatcattgccggtgtggggctggttttccccgttggaatggggttatttgccatcgccaacggcattcaaatcggtatgggatctttgctgtcccgcgccatcggcatgcagcggttggatcgtgcacagcggattttgtcggtcggtatcatcatcgcgctattctttgcgatcgtgatcaccgtacttggctatgtttatgcccagccgctattgcgctcactgggggccacgaagagcatcatcggctacgcaacggagttctattattattcgctgctgaccgtgttcagcatcatgttgattggcgtcatgatggggctgtttcaaggcgcgggtaagatcatggtcatcatgaaggcctcattgttgggggcgttggtaaatattatgctcgatccaatcatgatctttgtattcgattttggtgtgaaaggggtggcattggcgtcgtttctggcgcaactgagtatggtcgcctatttcatctacacattgatgggattacatatcgggttgagtatacgcatcgcgttacgcccattctcctggaaaatctaccgagagtttctctccgtcggcatggcgcagatgctgatgcaactgatcattgcggtcggcatagtgatttataatttttttatcgtcaggctggacgtaaacgcgatggcagcgtttacgctcactggtcgcatcgactatttcatcatcacgccgatgctggctatcgcgaccgcgttgctgactgtggtggggcaaaactggggacacggaaatgtcacccgcacgctgaatgcctattgggccgccgtcgcgctggccttctctattgtgctggtgttagccgttatgcatattgtactggcaccctggatgtatcccctgtttactcgtgttgttgccgtgagtgactatgcggtactgcaaacccgtatcatggcactggcactaccctttgtcgctatcagcctgttagcaagtgaatattatcaggccattggtaagccttggtattcggtgttgttgacgctgatgcgtcacgtgtttatatctgtccctgtcgtatacctgctggcgattgtgttagagatgcgtattaccggcgtctattttggggcgatgagcggcacttttgtggctgcgttgttggcgtggcgtctgctgcgtctttcacctcgtctgctgcgatggaatcaggaggcggtgcgctcccaacacttggatatggaggtggcacca

SEQ ID NO: 40 - protein, 479 aa, Escherichia coli
MTVNKLEPDNGTPNDELFTVAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 41 - DNA, 1431 bp, Escherichia coli
  CDS (1)..(1431): First CDS region
gtgaataagcttgagccagacaacggcacgccgaacgatgagctgttcacggtggcgggtatgtttgacggctcgctgtataaattactcctgcgcatggcgttgccgatgtttgtcggtatgttaacgcaggtgacctatgccatcgccgatattttttggctgagccacattgatgtcaccaacagcggcatcattgccggtgtggggctggttttccccgttggaatggggttatttgccatcgccaacggcattcaaatcggtatgggatctttgctgtcccgcgccatcggcatgcagcggttggatcgtgcacagcggattttgtcggtcggtatcatcatcgcgctattctttgcgatcgtgatcaccgtacttggctatgtttatgcccagccgctattgcgctcactgggggccacgaagagcatcatcggctacgcaacggagttctattattattcgctgctgaccgtgttcagcatcatgttgattggcgtcatgatggggctgtttcaaggcgcgggtaagatcatggtcatcatgaaggcctcattgttgggggcgttggtaaatattatgctcgatccaatcatgatctttgtattcgattttggtgtgaaaggggtggcattggcgtcgtttctggcgcaactgagtatggtcgcctatttcatctacacattgatgggattacatatcgggttgagtatacgcatcgcgttacgcccattctcctggaaaatctaccgagagtttctctccgtcggcatggcgcagatgctgatgcaactgatcattgcggtcggcatagtgatttataatttttttatcgtcaggctggacgtaaacgcgatggcagcgtttacgctcactggtcgcatcgactatttcatcatcacgccgatgctggctatcgcgaccgcgttgctgactgtggtggggcaaaactggggacacggaaatgtcacccgcacgctgaatgcctattgggccgccgtcgcgctggccttctctattgtgctggtgttagccgttatgcatattgtactggcaccctggatgtatcccctgtttactcgtgttgttgccgtgagtgactatgcggtactgcaaacccgtatcatggcactggcactaccctttgtcgctatcagcctgttagcaagtgaatattatcaggccattggtaagccttggtattcggtgttgttgacgctgatgcgtcacgtgtttatatctgtccctgtcgtatacctgctggcgattgtgttagagatgcgtattaccggcgtctattttggggcgatgagcggcacttttgtggctgcgttgttggcgtggcgtctgctgcgtctttcacctcgtctgctgcgatggaatcaggaggcggtgcgctcccaacacttggatatggaggtggcacca

SEQ ID NO: 42 - protein, 477 aa, Escherichia coli
VNKLEPDNGTPNDELFTVAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 43 - DNA, 1380 bp, Escherichia coli
  CDS (1)..(1380): First CDS region
gtggcgggtatgtttgacggctcgctgtataaattactcctgcgcatggcgttgccgatgtttgtcggtatgttaacgcaggtgacctatgccatcgccgatattttttggctgagccacattgatgtcaccaacagcggcatcattgccggtgtggggctggttttccccgttggaatggggttatttgccatcgccaacggcattcaaatcggtatgggatctttgctgtcccgcgccatcggcatgcagcggttggatcgtgcacagcggattttgtcggtcggtatcatcatcgcgctattctttgcgatcgtgatcaccgtacttggctatgtttatgcccagccgctattgcgctcactgggggccacgaagagcatcatcggctacgcaacggagttctattattattcgctgctgaccgtgttcagcatcatgttgattggcgtcatgatggggctgtttcaaggcgcgggtaagatcatggtcatcatgaaggcctcattgttgggggcgttggtaaatattatgctcgatccaatcatgatctttgtattcgattttggtgtgaaaggggtggcattggcgtcgtttctggcgcaactgagtatggtcgcctatttcatctacacattgatgggattacatatcgggttgagtatacgcatcgcgttacgcccattctcctggaaaatctaccgagagtttctctccgtcggcatggcgcagatgctgatgcaactgatcattgcggtcggcatagtgatttataatttttttatcgtcaggctggacgtaaacgcgatggcagcgtttacgctcactggtcgcatcgactatttcatcatcacgccgatgctggctatcgcgaccgcgttgctgactgtggtggggcaaaactggggacacggaaatgtcacccgcacgctgaatgcctattgggccgccgtcgcgctggccttctctattgtgctggtgttagccgttatgcatattgtactggcaccctggatgtatcccctgtttactcgtgttgttgccgtgagtgactatgcggtactgcaaacccgtatcatggcactggcactaccctttgtcgctatcagcctgttagcaagtgaatattatcaggccattggtaagccttggtattcggtgttgttgacgctgatgcgtcacgtgtttatatctgtccctgtcgtatacctgctggcgattgtgttagagatgcgtattaccggcgtctattttggggcgatgagcggcacttttgtggctgcgttgttggcgtggcgtctgctgcgtctttcacctcgtctgctgcgatggaatcaggaggcggtgcgctcccaacacttggatatggaggtggcacca

SEQ ID NO: 44 - protein, 460 aa, Escherichia coli
VAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 45 - DNA, 1371 bp, Escherichia coli
  CDS (1)..(1371): First CDS region
atgtttgacggctcgctgtataaattactcctgcgcatggcgttgccgatgtttgtcggtatgttaacgcaggtgacctatgccatcgccgatattttttggctgagccacattgatgtcaccaacagcggcatcattgccggtgtggggctggttttccccgttggaatggggttatttgccatcgccaacggcattcaaatcggtatgggatctttgctgtcccgcgccatcggcatgcagcggttggatcgtgcacagcggattttgtcggtcggtatcatcatcgcgctattctttgcgatcgtgatcaccgtacttggctatgtttatgcccagccgctattgcgctcactgggggccacgaagagcatcatcggctacgcaacggagttctattattattcgctgctgaccgtgttcagcatcatgttgattggcgtcatgatggggctgtttcaaggcgcgggtaagatcatggtcatcatgaaggcctcattgttgggggcgttggtaaatattatgctcgatccaatcatgatctttgtattcgattttggtgtgaaaggggtggcattggcgtcgtttctggcgcaactgagtatggtcgcctatttcatctacacattgatgggattacatatcgggttgagtatacgcatcgcgttacgcccattctcctggaaaatctaccgagagtttctctccgtcggcatggcgcagatgctgatgcaactgatcattgcggtcggcatagtgatttataatttttttatcgtcaggctggacgtaaacgcgatggcagcgtttacgctcactggtcgcatcgactatttcatcatcacgccgatgctggctatcgcgaccgcgttgctgactgtggtggggcaaaactggggacacggaaatgtcacccgcacgctgaatgcctattgggccgccgtcgcgctggccttctctattgtgctggtgttagccgttatgcatattgtactggcaccctggatgtatcccctgtttactcgtgttgttgccgtgagtgactatgcggtactgcaaacccgtatcatggcactggcactaccctttgtcgctatcagcctgttagcaagtgaatattatcaggccattggtaagccttggtattcggtgttgttgacgctgatgcgtcacgtgtttatatctgtccctgtcgtatacctgctggcgattgtgttagagatgcgtattaccggcgtctattttggggcgatgagcggcacttttgtggctgcgttgttggcgtggcgtctgctgcgtctttcacctcgtctgctgcgatggaatcaggaggcggtgcgctcccaacacttggatatggaggtggcacca

SEQ ID NO: 46 - protein, 457 aa, Escherichia coli
MFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 47 - DNA, 1461 bp, Escherichia coli
  CDS (1)..(1461): First CDS region
atgagtgagcagagctatcgtagcgcagggacactgttggcacagttggcgtccggagaaaccacctcagtggcgttggtgaatcactatttttcacgtatggcgcagtttaacaagccgttgaatgcggtggtgcagcagcactatgcgttggcgttggaggccgccgcgcgcgccgatcgtgagcgactggaggggcgcgcaaggggcgtgttgcacggattaccttgtactgttaaggagtcgtttgacgtgcaagggtggttaaccacgtccggtgcccattatctgaaagataaccgggcgacgcaggatgctccttccatcgcacgcttacgcgctgccggggcgatcctgatgggaaaaaccaatgtgccgatgatgactgccgattggcaaacctataacgatctgtatggcaccacccataacctgtgggataggcaacgttcacccggcggatcgtccggaggagcggcggtggcggtggcggcggatttcacccccgtggaatttggcagcgatttgtttggctcactgcgcattcccgcacactacacaggtgtctatgcccatcgttgtagcttggggttgatgtcggtcagaggacatgtgcccggtggtggtccgcaagcgactgatgagccggatctctcgacggcgggccccatggcgcgcagcgcggcggatctgcgtctgatgatgcgcgcattgagcacattctgggtggaaccgccgcgtattcccgattttagccgttatcaggccaaagcaaactaccgcgtgtgcacgtggtttagtgcgccccaccatgagatagatcaacagatcgcacagcgttttcaatcgtttatcgacaagttacgcgcacagcctggcgtggaggttgatgatgctatgcccgccgatatcgatcccgacgcactgtttgatatagcagtcaaactcagtggtcggctggtaagtacggcgctcaatggacgccagcgtcttacagccgggctggctgcgctgggcttcaggcttgtgggcaagctggcggatgtgcctgaggggataacgagctattaccagggcatgctgaaagacagtggcgaacagcggaatacagacaaactccgccacgaatacagccgggtgatagaaacccttttcgcgcgttatgacgtgttgttgacacctgtcagcccggtgctggcgtttgcgcacatgcagcagccggtgcgtaagcgcaagcttatcgtcaatggcgaaccgcaagattacaacgaacatttgttctggaacatgttagcaacggtttttggtttgcctgccaccgtttacccattggcgaaaacgatggatgagcttccgtgcggcatacagatcatttccgggcattttcacgatgatgtgacgattaactttgctgagttctgcgaaagcatcagtggcggattcacggtaccggaagggtac

SEQ ID NO: 48 - protein, 487 aa, Escherichia coli
MSEQSYRSAGTLLAQLASGETTSVALVNHYFSRMAQFNKPLNAVVQQHYALALEAAARADRERLEGRARGVLHGLPCTVKESFDVQGWLTTSGAHYLKDNRATQDAPSIARLRAAGAILMGKTNVPMMTADWQTYNDLYGTTHNLWDRQRSPGGSSGGAAVAVAADFTPVEFGSDLFGSLRIPAHYTGVYAHRCSLGLMSVRGHVPGGGPQATDEPDLSTAGPMARSAADLRLMMRALSTFWVEPPRIPDFSRYQAKANYRVCTWFSAPHHEIDQQIAQRFQSFIDKLRAQPGVEVDDAMPADIDPDALFDIAVKLSGRLVSTALNGRQRLTAGLAALGFRLVGKLADVPEGITSYYQGMLKDSGEQRNTDKLRHEYSRVIETLFARYDVLLTPVSPVLAFAHMQQPVRKRKLIVNGEPQDYNEHLFWNMLATVFGLPATVYPLAKTMDELPCGIQIISGHFHDDVTINFAEFCESISGGFTVPEGY

SEQ ID NO: 49 - DNA, 1488 bp, Escherichia coli
  CDS (1)..(1488): First CDS region
gtgcccaacagggagaaaagggcgatgagtgagcagagctatcgtagcgcagggacactgttggcacagttggcgtccggagaaaccacctcagtggcgttggtgaatcactatttttcacgtatggcgcagtttaacaagccgttgaatgcggtggtgcagcagcactatgcgttggcgttggaggccgccgcgcgcgccgatcgtgagcgactggaggggcgcgcaaggggcgtgttgcacggattaccttgtactgttaaggagtcgtttgacgtgcaagggtggttaaccacgtccggtgcccattatctgaaagataaccgggcgacgcaggatgctccttccatcgcacgcttacgcgctgccggggcgatcctgatgggaaaaaccaatgtgccgatgatgactgccgattggcaaacctataacgatctgtatggcaccacccataacctgtgggataggcaacgttcacccggcggatcgtccggaggagcggcggtggcggtggcggcggatttcacccccgtggaatttggcagcgatttgtttggctcactgcgcattcccgcacactacacaggtgtctatgcccatcgttgtagcttggggttgatgtcggtcagaggacatgtgcccggtggtggtccgcaagcgactgatgagccggatctctcgacggcgggccccatggcgcgcagcgcggcggatctgcgtctgatgatgcgcgcattgagcacattctgggtggaaccgccgcgtattcccgattttagccgttatcaggccaaagcaaactaccgcgtgtgcacgtggtttagtgcgccccaccatgagatagatcaacagatcgcacagcgttttcaatcgtttatcgacaagttacgcgcacagcctggcgtggaggttgatgatgctatgcccgccgatatcgatcccgacgcactgtttgatatagcagtcaaactcagtggtcggctggtaagtacggcgctcaatggacgccagcgtcttacagccgggctggctgcgctgggcttcaggcttgtgggcaagctggcggatgtgcctgaggggataacgagctattaccagggcatgctgaaagacagtggcgaacagcggaatacagacaaactccgccacgaatacagccgggtgatagaaacccttttcgcgcgttatgacgtgttgttgacacctgtcagcccggtgctggcgtttgcgcacatgcagcagccggtgcgtaagcgcaagcttatcgtcaatggcgaaccgcaagattacaacgaacatttgttctggaacatgttagcaacggtttttggtttgcctgccaccgtttacccattggcgaaaacgatggatgagcttccgtgcggcatacagatcatttccgggcattttcacgatgatgtgacgattaactttgctgagttctgcgaaagcatcagtggcggattcacggtaccggaagggtactag

SEQ ID NO: 50 - protein, 495 aa, Escherichia coli
VPNREKRAMSEQSYRSAGTLLAQLASGETTSVALVNHYFSRMAQFNKPLNAVVQQHYALALEAAARADRERLEGRARGVLHGLPCTVKESFDVQGWLTTSGAHYLKDNRATQDAPSIARLRAAGAILMGKTNVPMMTADWQTYNDLYGTTHNLWDRQRSPGGSSGGAAVAVAADFTPVEFGSDLFGSLRIPAHYTGVYAHRCSLGLMSVRGHVPGGGPQATDEPDLSTAGPMARSAADLRLMMRALSTFWVEPPRIPDFSRYQAKANYRVCTWFSAPHHEIDQQIAQRFQSFIDKLRAQPGVEVDDAMPADIDPDALFDIAVKLSGRLVSTALNGRQRLTAGLAALGFRLVGKLADVPEGITSYYQGMLKDSGEQRNTDKLRHEYSRVIETLFARYDVLLTPVSPVLAFAHMQQPVRKRKLIVNGEPQDYNEHLFWNMLATVFGLPATVYPLAKTMDELPCGIQIISGHFHDDVTINFAEFCESISGGFTVPEGY

SEQ ID NO: 51 - DNA, 1392 bp, Escherichia coli
  CDS (1)..(1392): First CDS region
gtggcgttggtgaatcactatttttcacgtatggcgcagtttaacaagccgttgaatgcggtggtgcagcagcactatgcgttggcgttggaggccgccgcgcgcgccgatcgtgagcgactggaggggcgcgcaaggggcgtgttgcacggattaccttgtactgttaaggagtcgtttgacgtgcaagggtggttaaccacgtccggtgcccattatctgaaagataaccgggcgacgcaggatgctccttccatcgcacgcttacgcgctgccggggcgatcctgatgggaaaaaccaatgtgccgatgatgactgccgattggcaaacctataacgatctgtatggcaccacccataacctgtgggataggcaacgttcacccggcggatcgtccggaggagcggcggtggcggtggcggcggatttcacccccgtggaatttggcagcgatttgtttggctcactgcgcattcccgcacactacacaggtgtctatgcccatcgttgtagcttggggttgatgtcggtcagaggacatgtgcccggtggtggtccgcaagcgactgatgagccggatctctcgacggcgggccccatggcgcgcagcgcggcggatctgcgtctgatgatgcgcgcattgagcacattctgggtggaaccgccgcgtattcccgattttagccgttatcaggccaaagcaaactaccgcgtgtgcacgtggtttagtgcgccccaccatgagatagatcaacagatcgcacagcgttttcaatcgtttatcgacaagttacgcgcacagcctggcgtggaggttgatgatgctatgcccgccgatatcgatcccgacgcactgtttgatatagcagtcaaactcagtggtcggctggtaagtacggcgctcaatggacgccagcgtcttacagccgggctggctgcgctgggcttcaggcttgtgggcaagctggcggatgtgcctgaggggataacgagctattaccagggcatgctgaaagacagtggcgaacagcggaatacagacaaactccgccacgaatacagccgggtgatagaaacccttttcgcgcgttatgacgtgttgttgacacctgtcagcccggtgctggcgtttgcgcacatgcagcagccggtgcgtaagcgcaagcttatcgtcaatggcgaaccgcaagattacaacgaacatttgttctggaacatgttagcaacggtttttggtttgcctgccaccgtttacccattggcgaaaacgatggatgagcttccgtgcggcatacagatcatttccgggcattttcacgatgatgtgacgattaactttgctgagttctgcgaaagcatcagtggcggattcacggtaccggaagggtac

SEQ ID NO: 52 - protein, 464 aa, Escherichia coli
VALVNHYFSRMAQFNKPLNAVVQQHYALALEAAARADRERLEGRARGVLHGLPCTVKESFDVQGWLTTSGAHYLKDNRATQDAPSIARLRAAGAILMGKTNVPMMTADWQTYNDLYGTTHNLWDRQRSPGGSSGGAAVAVAADFTPVEFGSDLFGSLRIPAHYTGVYAHRCSLGLMSVRGHVPGGGPQATDEPDLSTAGPMARSAADLRLMMRALSTFWVEPPRIPDFSRYQAKANYRVCTWFSAPHHEIDQQIAQRFQSFIDKLRAQPGVEVDDAMPADIDPDALFDIAVKLSGRLVSTALNGRQRLTAGLAALGFRLVGKLADVPEGITSYYQGMLKDSGEQRNTDKLRHEYSRVIETLFARYDVLLTPVSPVLAFAHMQQPVRKRKLIVNGEPQDYNEHLFWNMLATVFGLPATVYPLAKTMDELPCGIQIISGHFHDDVTINFAEFCESISGGFTVPEGY

SEQ ID NO: 53 - DNA, 1383 bp, Escherichia coli
  CDS (1)..(1383): First CDS region
gtgaatcactatttttcacgtatggcgcagtttaacaagccgttgaatgcggtggtgcagcagcactatgcgttggcgttggaggccgccgcgcgcgccgatcgtgagcgactggaggggcgcgcaaggggcgtgttgcacggattaccttgtactgttaaggagtcgtttgacgtgcaagggtggttaaccacgtccggtgcccattatctgaaagataaccgggcgacgcaggatgctccttccatcgcacgcttacgcgctgccggggcgatcctgatgggaaaaaccaatgtgccgatgatgactgccgattggcaaacctataacgatctgtatggcaccacccataacctgtgggataggcaacgttcacccggcggatcgtccggaggagcggcggtggcggtggcggcggatttcacccccgtggaatttggcagcgatttgtttggctcactgcgcattcccgcacactacacaggtgtctatgcccatcgttgtagcttggggttgatgtcggtcagaggacatgtgcccggtggtggtccgcaagcgactgatgagccggatctctcgacggcgggccccatggcgcgcagcgcggcggatctgcgtctgatgatgcgcgcattgagcacattctgggtggaaccgccgcgtattcccgattttagccgttatcaggccaaagcaaactaccgcgtgtgcacgtggtttagtgcgccccaccatgagatagatcaacagatcgcacagcgttttcaatcgtttatcgacaagttacgcgcacagcctggcgtggaggttgatgatgctatgcccgccgatatcgatcccgacgcactgtttgatatagcagtcaaactcagtggtcggctggtaagtacggcgctcaatggacgccagcgtcttacagccgggctggctgcgctgggcttcaggcttgtgggcaagctggcggatgtgcctgaggggataacgagctattaccagggcatgctgaaagacagtggcgaacagcggaatacagacaaactccgccacgaatacagccgggtgatagaaacccttttcgcgcgttatgacgtgttgttgacacctgtcagcccggtgctggcgtttgcgcacatgcagcagccggtgcgtaagcgcaagcttatcgtcaatggcgaaccgcaagattacaacgaacatttgttctggaacatgttagcaacggtttttggtttgcctgccaccgtttacccattggcgaaaacgatggatgagcttccgtgcggcatacagatcatttccgggcattttcacgatgatgtgacgattaactttgctgagttctgcgaaagcatcagtggcggattcacggtaccggaagggtac

SEQ ID NO: 54 - protein, 461 aa, Escherichia coli
VNHYFSRMAQFNKPLNAVVQQHYALALEAAARADRERLEGRARGVLHGLPCTVKESFDVQGWLTTSGAHYLKDNRATQDAPSIARLRAAGAILMGKTNVPMMTADWQTYNDLYGTTHNLWDRQRSPGGSSGGAAVAVAADFTPVEFGSDLFGSLRIPAHYTGVYAHRCSLGLMSVRGHVPGGGPQATDEPDLSTAGPMARSAADLRLMMRALSTFWVEPPRIPDFSRYQAKANYRVCTWFSAPHHEIDQQIAQRFQSFIDKLRAQPGVEVDDAMPADIDPDALFDIAVKLSGRLVSTALNGRQRLTAGLAALGFRLVGKLADVPEGITSYYQGMLKDSGEQRNTDKLRHEYSRVIETLFARYDVLLTPVSPVLAFAHMQQPVRKRKLIVNGEPQDYNEHLFWNMLATVFGLPATVYPLAKTMDELPCGIQIISGHFHDDVTINFAEFCESISGGFTVPEGY

SEQ ID NO: 55 - DNA, 6465 bp, Escherichia coli
  CDS (1)..(6465): First CDS region
atgacttacagtgaaagcgatattgccattgttggcatgaactgccggtaccccggcgtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaaatcgagcgctgcattgcgcgacatcccgatgtggagcagtcagtggtggtggcagtgggtaattctcaacatcgtcggctggtcgcttttgccaaactgcacgatcgccaccaggcgcaggcattgcaagctaaggaagcggaggcggcggcactggcgcagggtattattgtgaatccggcacagcgtctagcgttcaaactcaaggagccacatattcgcgcgctggatggtctgggcattgcactgacggcaccggcggatagcacacgttacatcaaacgccgcagctatcgtcatttcagcgcgcaaaaaaccacgctggcacagttggggcaattgctgtcgggcttggggcagatgcgtctacccggtctaccttttgccaagtatgcctatgcgtccgccggggggctatacccggtgcaaacctacgtgtacctgcatccagacaagatcgaagagggagtatccggtatttactacttcgacccgcgacagagctgtcttatgccggtagcaccagaagtcgagctgaacagtggttttcatgccggacctaatcagtctattgccgatcgggcggcattcacgctgtttatggtggctgatatggcggtgatctcgccattctatgggcaagaggcagcttggcacttctcggtgatggaagcaggtactctctgccatttactggaagaagatgcgccgcgctacggattggggctgtgccaacttgggatggcagacttttccgctgtggcatcgcattttcaattgtcgccacatcatcgctatgtccattgcaccgtggggggcgcgatagggcaagaggcggcaagtgctgcagcattgctgcgcgatttctccacctatgagaaaccgaaggaaaccgctgcgccgctggacatgcagagctacaaagatgccatgctgcgcggcctgcgtcagcaactgcctgactatatggtgccgagtgatctgatgttagcgaccgattttccgttaaccgctaacggcaagctagatcggcaaaaattacagctgcagggcgaacaaattgcccaccagcgtgacggcgtgggtccaatccaggtggacagtgcgttacaacagcggctggtggcgctctggcaggaggtactcggcgtgagccacgtgtcggccgaagacgatttcttctcgctggggggcagttctatagaattggtgcgtattcagcaggcacttgaggcgattatcgggcaggagattcccattgtcgatctgttccgtctgccaaccatcgcggatgtggcgcgttaccttgatgagcaactgcacaatctacccgccgcccacgatatcgtattagcgcaggctgaggtttcgcaggtcagcgctgcgcgcgagaatctggcgttgcggcgtaaacgtgcccaacagggagaaaagggcgatgagtga

SEQ ID NO: 56 - protein, 2154 aa, Escherichia coli
MTYSESDIAIVGMNCRYPGVHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 57 - DNA, 6537 bp, Escherichia coli
  CDS (1)..(6537): First CDS region
gtgatgcttcccgatcccgcgcccagcaacgacttgtacgtcgtcaccagcgtcagcgttaaggaaaaactaatgacttacagtgaaagcgatattgccattgttggcatgaactgccggtaccccggcgtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaaatcgagcgctgcattgcgcgacatcccgatgtggagcagtcagtggtggtggcagtgggtaattctcaacatcgtcggctggtcgcttttgccaaactgcacgatcgccaccaggcgcaggcattgcaagctaaggaagcggaggcggcggcactggcgcagggtattattgtgaatccggcacagcgtctagcgttcaaactcaaggagccacatattcgcgcgctggatggtctgggcattgcactgacggcaccggcggatagcacacgttacatcaaacgccgcagctatcgtcatttcagcgcgcaaaaaaccacgctggcacagttggggcaattgctgtcgggcttggggcagatgcgtctacccggtctaccttttgccaagtatgcctatgcgtccgccggggggctatacccggtgcaaacctacgtgtacctgcatccagacaagatcgaagagggagtatccggtatttactacttcgacccgcgacagagctgtcttatgccggtagcaccagaagtcgagctgaacagtggttttcatgccggacctaatcagtctattgccgatcgggcggcattcacgctgtttatggtggctgatatggcggtgatctcgccattctatgggcaagaggcagcttggcacttctcggtgatggaagcaggtactctctgccatttactggaagaagatgcgccgcgctacggattggggctgtgccaacttgggatggcagacttttccgctgtggcatcgcattttcaattgtcgccacatcatcgctatgtccattgcaccgtggggggcgcgatagggcaagaggcggcaagtgctgcagcattgctgcgcgatttctccacctatgagaaaccgaaggaaaccgctgcgccgctggacatgcagagctacaaagatgccatgctgcgcggcctgcgtcagcaactgcctgactatatggtgccgagtgatctgatgttagcgaccgattttccgttaaccgctaacggcaagctagatcggcaaaaattacagctgcagggcgaacaaattgcccaccagcgtgacggcgtgggtccaatccaggtggacagtgcgttacaacagcggctggtggcgctctggcaggaggtactcggcgtgagccacgtgtcggccgaagacgatttcttctcgctggggggcagttctatagaattggtgcgtattcagcaggcacttgaggcgattatcgggcaggagattcccattgtcgatctgttccgtctgccaaccatcgcggatgtggcgcgttaccttgatgagcaactgcacaatctacccgccgcccacgatatcgtattagcgcaggctgaggtttcgcaggtcagcgctgcgcgcgagaatctggcgttgcggcgtaaacgtgcccaacagggagaaaagggcgatgagtga

SEQ ID NO: 58 - protein, 2178 aa, Escherichia coli
VMLPDPAPSNDLYVVTSVSVKEKLMTYSESDIAIVGMNCRYPGVHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 59 - DNA, 6534 bp, Escherichia coli
  CDS (1)..(6534): First CDS region
atgcttcccgatcccgcgcccagcaacgacttgtacgtcgtcaccagcgtcagcgttaaggaaaaactaatgacttacagtgaaagcgatattgccattgttggcatgaactgccggtaccccggcgtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaaatcgagcgctgcattgcgcgacatcccgatgtggagcagtcagtggtggtggcagtgggtaattctcaacatcgtcggctggtcgcttttgccaaactgcacgatcgccaccaggcgcaggcattgcaagctaaggaagcggaggcggcggcactggcgcagggtattattgtgaatccggcacagcgtctagcgttcaaactcaaggagccacatattcgcgcgctggatggtctgggcattgcactgacggcaccggcggatagcacacgttacatcaaacgccgcagctatcgtcatttcagcgcgcaaaaaaccacgctggcacagttggggcaattgctgtcgggcttggggcagatgcgtctacccggtctaccttttgccaagtatgcctatgcgtccgccggggggctatacccggtgcaaacctacgtgtacctgcatccagacaagatcgaagagggagtatccggtatttactacttcgacccgcgacagagctgtcttatgccggtagcaccagaagtcgagctgaacagtggttttcatgccggacctaatcagtctattgccgatcgggcggcattcacgctgtttatggtggctgatatggcggtgatctcgccattctatgggcaagaggcagcttggcacttctcggtgatggaagcaggtactctctgccatttactggaagaagatgcgccgcgctacggattggggctgtgccaacttgggatggcagacttttccgctgtggcatcgcattttcaattgtcgccacatcatcgctatgtccattgcaccgtggggggcgcgatagggcaagaggcggcaagtgctgcagcattgctgcgcgatttctccacctatgagaaaccgaaggaaaccgctgcgccgctggacatgcagagctacaaagatgccatgctgcgcggcctgcgtcagcaactgcctgactatatggtgccgagtgatctgatgttagcgaccgattttccgttaaccgctaacggcaagctagatcggcaaaaattacagctgcagggcgaacaaattgcccaccagcgtgacggcgtgggtccaatccaggtggacagtgcgttacaacagcggctggtggcgctctggcaggaggtactcggcgtgagccacgtgtcggccgaagacgatttcttctcgctggggggcagttctatagaattggtgcgtattcagcaggcacttgaggcgattatcgggcaggagattcccattgtcgatctgttccgtctgccaaccatcgcggatgtggcgcgttaccttgatgagcaactgcacaatctacccgccgcccacgatatcgtattagcgcaggctgaggtttcgcaggtcagcgctgcgcgcgagaatctggcgttgcggcgtaaacgtgcccaacagggagaaaagggcgatgagtga

SEQ ID NO: 60 - protein, 2177 aa, Escherichia coli
MLPDPAPSNDLYVVTSVSVKEKLMTYSESDIAIVGMNCRYPGVHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 61 - DNA, 6405 bp, Escherichia coli
  CDS (1)..(6405): First CDS region
gtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaaatcgagcgctgcattgcgcgacatcccgatgtggagcagtcagtggtggtggcagtgggtaattctcaacatcgtcggctggtcgcttttgccaaactgcacgatcgccaccaggcgcaggcattgcaagctaaggaagcggaggcggcggcactggcgcagggtattattgtgaatccggcacagcgtctagcgttcaaactcaaggagccacatattcgcgcgctggatggtctgggcattgcactgacggcaccggcggatagcacacgttacatcaaacgccgcagctatcgtcatttcagcgcgcaaaaaaccacgctggcacagttggggcaattgctgtcgggcttggggcagatgcgtctacccggtctaccttttgccaagtatgcctatgcgtccgccggggggctatacccggtgcaaacctacgtgtacctgcatccagacaagatcgaagagggagtatccggtatttactacttcgacccgcgacagagctgtcttatgccggtagcaccagaagtcgagctgaacagtggttttcatgccggacctaatcagtctattgccgatcgggcggcattcacgctgtttatggtggctgatatggcggtgatctcgccattctatgggcaagaggcagcttggcacttctcggtgatggaagcaggtactctctgccatttactggaagaagatgcgccgcgctacggattggggctgtgccaacttgggatggcagacttttccgctgtggcatcgcattttcaattgtcgccacatcatcgctatgtccattgcaccgtggggggcgcgatagggcaagaggcggcaagtgctgcagcattgctgcgcgatttctccacctatgagaaaccgaaggaaaccgctgcgccgctggacatgcagagctacaaagatgccatgctgcgcggcctgcgtcagcaactgcctgactatatggtgccgagtgatctgatgttagcgaccgattttccgttaaccgctaacggcaagctagatcggcaaaaattacagctgcagggcgaacaaattgcccaccagcgtgacggcgtgggtccaatccaggtggacagtgcgttacaacagcggctggtggcgctctggcaggaggtactcggcgtgagccacgtgtcggccgaagacgatttcttctcgctggggggcagttctatagaattggtgcgtattcagcaggcacttgaggcgattatcgggcaggagattcccattgtcgatctgttccgtctgccaaccatcgcggatgtggcgcgttaccttgatgagcaactgcacaatctacccgccgcccacgatatcgtattagcgcaggctgaggtttcgcaggtcagcgctgcgcgcgagaatctggcgttgcggcgtaaacgtgcccaacagggagaaaagggcgatgag

SEQ ID NO: 62 - protein, 2135 aa, Escherichia coli
VHSVAAFETVLRTGCNILDPKVTPSNGHNHITLNNVYEHMAEFDANFFGYSRAEAEIMDPQQRVFLTCAWEMFEQSGYNPKQHDARVGLYAGVSTSFYLLTHLMNNPDKLAQLGGLQIMVGNDKDHLTSQLAYRLNITGPCVTVQASCATSLVAVHLACEGLLSGQCDMALAGGVTFRMEEQRSYESHGDGLQAEDGLIHTFDAQASGTVYSSGLGMVLLKRATDAQVQGDNILAVIKGSAINNDGGARSGYTVPGVDGQEAVMIEAHSLAEVTPQQIQYLELHGSGTPLGDAIEFAAIKRVFGTPAPNATPWRLGAVKPNVGHVEMASGITSLIKTVLSLTNRVFYPTLNFQRANPQLGLEDSPFEVVSRLTPWPEGTTPRTAGVSAFGLGGTNAHLVVQAPLSTPQARAQQMGPCVVVLSAKNHNALEQMQNALLAKLAAHPEIRLQDVAYTLRHGRFSAPVRKCVIAENCTQLARQLRDAPMVEATTGCTIYWRLGHRFVVALETLSDWLACSEVLSQAVGQLLEHFPLEPACLQDLSPAQRTFISQYALIALIDERETLNVVLCGDGDGGYAAAVLRGDCTLEQAWHRLNAGQPFDDVPTNPLLQPDVCSLMLDDAASDANRTALEALGQLWLAGVSLDWRWVDAAERMLGSQRIALPGTVFTPQRYWVEAVRPATFSHESSNNLLSRATKSDIIAVVTEIWERTLGVSIDDHHASFFELGGHSLLASTILYDIQQRYGITCTLSAFFADPTIEGLSCYLLEQGGSETAVSALPDTVFAPDQQHLPFPLTDVQQAYWVGRRKSLGLGNISTHIYVEYELQGLDETAFNRALNAVIARHSMLRAIVNDDGMQQILPNVPEYHVAFYTTQCEDAFQQRCRELRDTLSHQMIDCSRWPLFQMEVVVDPQQKARLHVSIDLLIADAWSLELFIRELAYHYRHPQAALPTLTYSFRDYVLTLKSYEKTPQFERARDYWRARIETLPPGPRLPLRTDPTKLENPTFVRRSYCLSRAIWQRLKTQAGQMSITPTTLLLTGFAQVLARFSSSPHFSLNLTLFNRLPLHADINHLIGDFTALTLLEIDMSQGETLQARANVIHSQLWRDLDNRLFGGIQVSRLLVQTHRDPAKSVIPIVFTSLLNQYEASWETDDTLFNQPQDDLYSISQTPQVWLDHQVMERNGELHFNWDVVEQLFEPALMDQMFQCYCQLLHALAQRPQLWHETQDVLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEIERCIARHPDVEQSVVVAVGNSQHRRLVAFAKLHDRHQAQALQAKEAEAAALAQGIIVNPAQRLAFKLKEPHIRALDGLGIALTAPADSTRYIKRRSYRHFSAQKTTLAQLGQLLSGLGQMRLPGLPFAKYAYASAGGLYPVQTYVYLHPDKIEEGVSGIYYFDPRQSCLMPVAPEVELNSGFHAGPNQSIADRAAFTLFMVADMAVISPFYGQEAAWHFSVMEAGTLCHLLEEDAPRYGLGLCQLGMADFSAVASHFQLSPHHRYVHCTVGGAIGQEAASAAALLRDFSTYEKPKETAAPLDMQSYKDAMLRGLRQQLPDYMVPSDLMLATDFPLTANGKLDRQKLQLQGEQIAHQRDGVGPIQVDSALQQRLVALWQEVLGVSHVSAEDDFFSLGGSSIELVRIQQALEAIIGQEIPIVDLFRLPTIADVARYLDEQLHNLPAAHDIVLAQAEVSQVSAARENLALRRKRAQQGEKGDE

SEQ ID NO: 63 - DNA, 6432 bp, Escherichia coli
  CDS (1)..(6432): First CDS region
atgacgatacatcatgccgcattggcgcgaatgttaccggcggaaaaaaaggaaaagctattacgacagttggcgcaatcaggcgtgtcgcccagccgcattcccatcatcaaagcggatccggcgcaggcaatcccgctgtcgtttaatcaggagcggttgtggtttttgcaaaaatacgacagtaccgccactaactacaacctttatgtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaaca

SEQ ID NO: 64 - protein, 2144 aa, Escherichia coli
MTIHHAALARMLPAEKKEKLLRQLAQSGVSPSRIPIIKADPAQAIPLSFNQERLWFLQKYDSTATNYNLYVVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQT

SEQ ID NO: 65 - DNA, 6402 bp, Escherichia coli
  CDS (1)..(6402): First CDS region
atgttaccggcggaaaaaaaggaaaagctattacgacagttggcgcaatcaggcgtgtcgcccagccgcattcccatcatcaaagcggatccggcgcaggcaatcccgctgtcgtttaatcaggagcggttgtggtttttgcaaaaatacgacagtaccgccactaactacaacctttatgtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaaca

SEQ ID NO: 66 - protein, 2134 aa, Escherichia coli
MLPAEKKEKLLRQLAQSGVSPSRIPIIKADPAQAIPLSFNQERLWFLQKYDSTATNYNLYVVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQT

SEQ ID NO: 67 - DNA, 6348 bp, Escherichia coli
  CDS (1)..(6348): First CDS region
gtgtcgcccagccgcattcccatcatcaaagcggatccggcgcaggcaatcccgctgtcgtttaatcaggagcggttgtggtttttgcaaaaatacgacagtaccgccactaactacaacctttatgtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaaca

SEQ ID NO: 68 - protein, 2116 aa, Escherichia coli
VSPSRIPIIKADPAQAIPLSFNQERLWFLQKYDSTATNYNLYVVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQT

SEQ ID NO: 69 - DNA, 6222 bp, Escherichia coli
  CDS (1)..(6222): First CDS region
gtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaaca

SEQ ID NO: 70 - protein, 2074 aa, Escherichia coli
VVYRLHGVVDMPMLTEALRHVQARHAILRTRIIVRNDRPCQVIDDASSLVLDTVTLAAQAPTSALDAVIQQVINTRFDLARGPLWGVTQIIQPDQGCHLVFCAHHIIIDGISLRLLFDELQQQYARLHAGNETSLPPPPLQYADYAFWQREWFQDTLLANELAYWRARLQDAPLLSTFPSLHPRPAQPSTHGSRFSITLDETLSLALKHVARTQETTPFVLMLTAFQLVLMRYAQQQRLVIGMPVSGRIRPELQSSIGYYASTAVIYTDFNGVEVGREALQRVKASVKETQGRQQLPFENLVNMLDLPRSLSHSPLFQILYIYHNHVTPRAFTLAGAYWEQVTYHNQTVKYDMTVEVFQNDATFDVSFEYDLGLYDADVVKQIAEALRQHCLSLTSSLETPIGAIPLHAPETATPRRDPLNATNVPWLGPQDVLRIIEQRCVQHPKQLAIQQHDGTLTYAELWARVQFIAMRFRAHGIQPGDRIGVLLPRHRDVIATMLATWFVGACYVPFDIHQPAARLQRLMQRARLVCLVVRQPGEWGEIVQLSLPELMQDMSNAIRYSTPCALLPDMQAYLLFTSGSTGEPKGVCVVHRGLLNLLLDMQRTFAVGSQDRLLSVTTPTFDISFLEYLLPLISGASLYLTEAERAADSFRMIPLIADYRPTLMQATPSFWHGLLMAGWRGDPELCVLAGGEALPTKVAEELLRCCGSLWNLYGPTETTIWSLKSQITQAENITLGAPIANTRIYILDNEGHPVPQGVDGELYIAGDGVAQGYDGQPELNAQFFLSEPGVPGGRMFRTGDLVRSDAQGQLFFVGRKDSQIKLRGYRIELGEIERTLARHPHVDAAVVACIERAPLHKALAAFIITSEPPSLFEQLKNELRQQLPDYMVPTLWQRVADFPNTDNGKIDRKRLAENFVADSSLVSPQTQALSDTEQMLLALWMRYLPIKNVDPECDFFRLGGHSLLAVTLVAEINRTFHCALTLKDIFHYSTLRALSARIAQQSITDAAASQDDWVIVHDPEHRHQPFPLTDVQRAYWLGRQTGATSIATHIYHEFDVEHFNVTRFTHAVNALIARHEMLRARVLPDGTQQILAQVPAYQLEQRDLSALSPNARNDALMAIRDRLSHHVHPADRWPLFDFSYSACTAQHGRLHFSLDLLIADALSMRTLQQELMMLYREPHVSLPLLPFSFRDYVQALLVEQASEAYARDQAYWQRALPQLYGPPTLPVQGDLAQLSAIRFVRRRHRLSAHNWGVLSALAQRTRITKTALLLTVFSQVLARWSLSPTFTLNLTLFNRPQGYPNAEAVIGDFTAVSLLNVCYDSQHSYAHNAQRIQVQLWEDLEHRRFSGIRASEALIHSGRFHAPMPVVFTSMLDIDGETTAQDPRDTTRFTLCPDANITQTPQVWLDHQVIELAGELHFNWDAVEQLFDTTLLDQMFGAYCHALQALVAMPQSWWGVNSSLALPTVSAPVTQAPAPTALLHHGLLRQAALTPQETALISPIRELTYRQLSTAADHVARALLALGVQHGDRVAVVMEKGWQQIAAVHGILRLGAVYLPVDPVLPPQRRQLLLTVGEVRVQVTQPGLTQLEPSLPVLIIDDGMLDTPAAPLPEVAGDVTDLAYIIFTSGSTGTPKGVMIDHRAAMNTLEDINERFGLNAQDRVFGLSSLSFDLSVYDAFAPFMVGAALVLPEAGREKDPRHWQTVMAHGHVSVWNAVPALMQMLCEYHSGDRMSYPTLRLALLSGDWIPLTLPEQMRERLNETMDIISLGGATECAIWSVYYPIGEVESTWTSIPYGRGLRNQPVYVLNAQLEECPVGVEGEICIGGMGLAQGYLNDAEKTAASFVWREASGERIYRTGDRGRYFADGQVAFLGRNDTQVKVNGYRIELGEVKSHLEQLDSVGSAAVVCHQGQLYAFITAAENLHPDDTDALLARVRAQLAVQLPYYLLPQHFFLLKVLPMTGNGKIDQAAMVQEVIQRMSQSTSQKSRALAHASPYEQQVAALWCEVLQREQIGLNDNFFEAGGGSIQIVLLHRRIEEIFKVTVPIAELFRLTTVKRIAGYLQAMQDNARAVNQT

SEQ ID NO: 71 - DNA, 3030 bp, Escherichia coli
  CDS (1)..(3030): First CDS region
atggcagagaatgattttggtatagctatcattgggatggcggggcgtttccctcaagccgatacggtacaggcgttttgggaaaatcttctggcaagccgagagtgcatttccttttacagcgatgaggaactgctggcgatgggaatcagtcctgaatttgttcagcacccagattacgtcaaggccaaaggggaggtagctgacatcgataaatttgatgctgctttcttcggtatcgcaccccgagaggcggagctgatggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgag

SEQ ID NO: 72 - protein, 1010 aa, Escherichia coli
MAENDFGIAIIGMAGRFPQADTVQAFWENLLASRECISFYSDEELLAMGISPEFVQHPDYVKAKGEVADIDKFDAAFFGIAPREAELMDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 73 - DNA, 2994 bp, Escherichia coli
  CDS (1)..(2994): First CDS region
atggcggggcgtttccctcaagccgatacggtacaggcgttttgggaaaatcttctggcaagccgagagtgcatttccttttacagcgatgaggaactgctggcgatgggaatcagtcctgaatttgttcagcacccagattacgtcaaggccaaaggggaggtagctgacatcgataaatttgatgctgctttcttcggtatcgcaccccgagaggcggagctgatggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgag

SEQ ID NO: 74 - protein, 998 aa, Escherichia coli
MAGRFPQADTVQAFWENLLASRECISFYSDEELLAMGISPEFVQHPDYVKAKGEVADIDKFDAAFFGIAPREAELMDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 75 - DNA, 2889 bp, Escherichia coli
  CDS (1)..(2889): First CDS region
atgggaatcagtcctgaatttgttcagcacccagattacgtcaaggccaaaggggaggtagctgacatcgataaatttgatgctgctttcttcggtatcgcaccccgagaggcggagctgatggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgag

SEQ ID NO: 76 - protein, 963 aa, Escherichia coli
MGISPEFVQHPDYVKAKGEVADIDKFDAAFFGIAPREAELMDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 77 - DNA, 2769 bp, Escherichia coli
  CDS (1)..(2769): First CDS region
atggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgag

SEQ ID NO: 78 - protein, 923 aa, Escherichia coli
MDPQHRVLLETAWAAFEDAGYVAADYPGDVGIFAGKSMDSYLMLNLMPHFKRVFSSGSLQAAIGNDKDSITTTIAYHLNLRGPAITVQTSSSTSLVAVCVACQSLLTWQCDMAIAGGVTLGPPAKTGYLSQEGGITAADGHCRAFSDNSSGFVPGTGAGLVVLKRVDEALRDGDNIYAVIKGFAVNNDGSEKISYTAPSVDAQARAIAQAQRLAGLTPQDITYVEAHGTGTRLGDPVEFSALSQAFAGASQKQYCALGSVKTNIGHLDTAAGVAGLIKTALAVQQGIIPATLHFERPNAQIDLTNSPFYINTTCQPWQPESGIRRAGVTSLGMGGTNAHVVLEQAPAVDLQARAPVPAYSILPFSAKTDSALSSGLARFADFLQHESLPDRRDLAWTLSQGRKAFAHRAALVTRDLHAAGTLLQQAATAPFARGVAQTQLGLGLLFSGQGSQYQRMGHQLYQVWPAYADAFDRCATLLEREYQLDIRHELFRAEVSLAQGERLAQTCLTQPLLFSVEYALAQLWLSWGITPTVMIGHSLGEWVAATLAGVFSLEDALRLVARRAELMHQAPSGAMLMVALPEAQIRALITAPLAIAAVNAPDYSVIAGPTSEILAVSQRLTEQNIINKRLHTSHAFHSSMMQDAAQALRQAFENVRLNPPTLTIISTVTGAHVSADTLTTPDYWIEQMLMPVQFSAALQEAQATFDVDFLEIGPGATLTQLTNGHALGDRLAFSSLPAGARSSDEHKHILDTVAALWVRGHNIDLSAFAGEQPRRVSLPTYAFDKIRYWVDSPEEQRSAVTPVADAGSVIPSEPSVRRQPRPAFSVPYAAPESKTQRGLVAICEALLGIDGLGIDDNFFEAGGHSLMLGMLLAQVQERFAVTLSFFDVMEDASVRALAQLVEQEQQDDGGSALAVLVNDMINE

SEQ ID NO: 79 - DNA, 4794 bp, Escherichia coli
  CDS (1)..(4794): First CDS region
atggaacagcaagggattatgagacagttgcctaccgacgaccaaacgatagtcgactatttgtatcgtatcgccggagaatatggggaaaaagccgctgtattgatgggggacgcggcgctgagctatcacgatcttaatgcacgctctaaccaactggcgcattatctgcgtgggctggggatcggcgaggatcgtgtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcac

SEQ ID NO: 80 - protein, 1598 aa, Escherichia coli
MEQQGIMRQLPTDDQTIVDYLYRIAGEYGEKAAVLMGDAALSYHDLNARSNQLAHYLRGLGIGEDRVVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 81 - DNA, 4776 bp, Escherichia coli
  CDS (1)..(4776): First CDS region
atgagacagttgcctaccgacgaccaaacgatagtcgactatttgtatcgtatcgccggagaatatggggaaaaagccgctgtattgatgggggacgcggcgctgagctatcacgatcttaatgcacgctctaaccaactggcgcattatctgcgtgggctggggatcggcgaggatcgtgtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcac

SEQ ID NO: 82 - protein, 1592 aa, Escherichia coli
MRQLPTDDQTIVDYLYRIAGEYGEKAAVLMGDAALSYHDLNARSNQLAHYLRGLGIGEDRVVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 83 - DNA, 4689 bp, Escherichia coli
  CDS (1)..(4689): First CDS region
atgggggacgcggcgctgagctatcacgatcttaatgcacgctctaaccaactggcgcattatctgcgtgggctggggatcggcgaggatcgtgtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcac

SEQ ID NO: 84 - protein, 1563 aa, Escherichia coli
MGDAALSYHDLNARSNQLAHYLRGLGIGEDRVVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 85 - DNA, 4596 bp, Escherichia coli
  CDS (1)..(4596): First CDS region
gtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcac

SEQ ID NO: 86 - protein, 1532 aa, Escherichia coli
VVAIRLPRGMAMLIAIFAIVKAGGAYLPLAYNAPRSRIENILSNSGAVCLIGTDDGDRWPIPRVEIDSAAVSAMPTTDLRYRPHARQLAYIIYTSGSTGVPKGVATEHAALLNRIVWMQNAYPISSQDVLFQKTVYTFDVSVWEMFWWAMYGASVVLLPSGLESDPRTLARLIQRHRVSVVHFVPSMLNLFVEYLEMKQDPRLTASLRLVFSSGEKLTVHSVARFYQSVAQGDLINLYGPTEAAIDVSHHRCLRGYDYDDIPIGQAIDGCRLYVLDDHGNPVADGEEGELYLAGIGLARGYLNNVALTDRCFTIHPTLRHLGKPERLYKTGDLVWRDGESQQIHYIGRNDFQIKIRGLRVELGEIEAHAMRFPGVQQAVVVADQDDPDNQLIYAFVVSSVPLNLAALMDALSKNLPAYMLPNRLLAMSELPLSDNGKCCRKTLLDLARAYSASRVDLRETPAVRYLPLSSAQSSMWFMQQLAPHTALYNNPTALLLEGELDRTRMDGAIRQLMSRHTLLRAMAETHNGQPVLAVPQCVSSQALLTIVPLPSVSDDNALQAMINQRAAHPMPLTSGTPLCRFELLTLDDDRSVLLIHLHHIISDGWSKGVLLRELQAAYNGESLTPEPLLEYADYMEYQEEWRQSDAYQDAMRYWQNTLAGTLPILDIPTDQPRQKVARYQGAFVAFALSANTCERVLAAARAQRVSLYNYLLTAFVLLLHRNARQQEYIVGMPIAARLTKEQEHMIAPLVNVLPLRLPLDEAASFSELVQTIRGILFAAFRHQRLEFTDIVRAVNVDRSAGHFPIYQCMFQLDNMPLASPTLNGVNVTPLLLDTSASQVDISLSMQHIDGRITGTFEYDAGLYSADRIQHLVAQWRELLDEASSQPTQLVRDLIRFTPREHAWLARHNATEVALPPVDNLLALVLPHCQQRPTQVALRHADDAMTYGELQQATMQMCTWLRAQGVKRGESVALQLPFCFELIIAQLAILSLGASYVPLDGNAPAARNALILAQATPCMLLVAQPLESPHGLTIPWVLVPDWRSLLTEIPNLPVSVAPDALDCDAVVIFTSGTTGQPKGVRLSQRNLVNLTASFISSYQVTHQDVLLPITSVASASFVGEVLPLLAAGGTLVLAQKAQSLDSDALIALLASQRVTILSTTPSLSASLSVLAQSMGSLRLFLCGGEALEYEQIAPLLPHMAVVNGYGLTESGICSTYFPVAKRREQETGALPIGRPIQNTQAYVVDAYNRLVPPGACGELCFSGLGISPGYLDARQDPERFVELPEYPGVRVLKTGDRARWATDGMLFYLGRQDRQVQIRGYRVELGDIESLLKQHPDIADAWVDVRRNAAATPLLVAFYCSVNGVALDAQQLRVWLSLRLPLHMLPLLYVPLSAMPLGVNGKIDPQCLPLVDLRQLEGPGEYVPPATELEQRLAEIWQQLLGLERVGTTTNFFDLGGHSLLLVQMQQYIGQQCGQHVALVDLLRFTTIKRLAEFLLAPDAAQGTTGDQTQLRAAKQRLAFGHTRWAATTDSHH

SEQ ID NO: 87 - DNA, 1266 bp, Escherichia coli
  CDS (1)..(1266): First CDS region
atgacgaaggatgtcgcactgatgttccctggctccggttcgcaatatgtaggcatggcacggtggctgtatgagcgttatccgcaggtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcg

SEQ ID NO: 88 - protein, 422 aa, Escherichia coli
MTKDVALMFPGSGSQYVGMARWLYERYPQVRTLFDEASQITERDMAALCLSGTLVQLAEPTAMALAIYTTSVAHFVAWQQFLAQTGVHVNLRYMLGHSLGEYAALTCSGALSFSQALALVAMRSRLASEIAREMDASTTIIKQGNQALVAAACEVAERETRQQVGIACFNSPQQFMLSGQNSAIIAAEQYLLDHDRQVEVVPLIGGVPYHSPLLKPCGQQLRKALDRCEWRRPCCPVISNVNAQPYPDTVTPVQWLEQQLSQPVQWQRSLTYLTGHLSPIAIEIGPQSVLKNLLLENRYPAPVYAFDNRHDRAQLALVLGDNMAVKTDPEAVRRQRITLLTNALTATRHHRAADVAASAQLKELLSRFFERIQQIEQRGTSSEEDIAFLHELLEQGFQLKGSSQAEIDACHARLASDNGGQA

SEQ ID NO: 89 - DNA, 1245 bp, Escherichia coli
  CDS (1)..(1245): First CDS region
atgttccctggctccggttcgcaatatgtaggcatggcacggtggctgtatgagcgttatccgcaggtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcg

SEQ ID NO: 90 - protein, 415 aa, Escherichia coli
MFPGSGSQYVGMARWLYERYPQVRTLFDEASQITERDMAALCLSGTLVQLAEPTAMALAIYTTSVAHFVAWQQFLAQTGVHVNLRYMLGHSLGEYAALTCSGALSFSQALALVAMRSRLASEIAREMDASTTIIKQGNQALVAAACEVAERETRQQVGIACFNSPQQFMLSGQNSAIIAAEQYLLDHDRQVEVVPLIGGVPYHSPLLKPCGQQLRKALDRCEWRRPCCPVISNVNAQPYPDTVTPVQWLEQQLSQPVQWQRSLTYLTGHLSPIAIEIGPQSVLKNLLLENRYPAPVYAFDNRHDRAQLALVLGDNMAVKTDPEAVRRQRITLLTNALTATRHHRAADVAASAQLKELLSRFFERIQQIEQRGTSSEEDIAFLHELLEQGFQLKGSSQAEIDACHARLASDNGGQA

SEQ ID NO: 91 - DNA, 1212 bp, Escherichia coli
  CDS (1)..(1212): First CDS region
atggcacggtggctgtatgagcgttatccgcaggtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcg

SEQ ID NO: 92 - protein, 404 aa, Escherichia coli
MARWLYERYPQVRTLFDEASQITERDMAALCLSGTLVQLAEPTAMALAIYTTSVAHFVAWQQFLAQTGVHVNLRYMLGHSLGEYAALTCSGALSFSQALALVAMRSRLASEIAREMDASTTIIKQGNQALVAAACEVAERETRQQVGIACFNSPQQFMLSGQNSAIIAAEQYLLDHDRQVEVVPLIGGVPYHSPLLKPCGQQLRKALDRCEWRRPCCPVISNVNAQPYPDTVTPVQWLEQQLSQPVQWQRSLTYLTGHLSPIAIEIGPQSVLKNLLLENRYPAPVYAFDNRHDRAQLALVLGDNMAVKTDPEAVRRQRITLLTNALTATRHHRAADVAASAQLKELLSRFFERIQQIEQRGTSSEEDIAFLHELLEQGFQLKGSSQAEIDACHARLASDNGGQA

SEQ ID NO: 93 - DNA, 1179 bp, Escherichia coli
  CDS (1)..(1179): First CDS region
gtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcg

SEQ ID NO: 94 - protein, 393 aa, Escherichia coli
VRTLFDEASQITERDMAALCLSGTLVQLAEPTAMALAIYTTSVAHFVAWQQFLAQTGVHVNLRYMLGHSLGEYAALTCSGALSFSQALALVAMRSRLASEIAREMDASTTIIKQGNQALVAAACEVAERETRQQVGIACFNSPQQFMLSGQNSAIIAAEQYLLDHDRQVEVVPLIGGVPYHSPLLKPCGQQLRKALDRCEWRRPCCPVISNVNAQPYPDTVTPVQWLEQQLSQPVQWQRSLTYLTGHLSPIAIEIGPQSVLKNLLLENRYPAPVYAFDNRHDRAQLALVLGDNMAVKTDPEAVRRQRITLLTNALTATRHHRAADVAASAQLKELLSRFFERIQQIEQRGTSSEEDIAFLHELLEQGFQLKGSSQAEIDACHARLASDNGGQA

SEQ ID NO: 95 - DNA, 1128 bp, Escherichia coli
  CDS (1)..(1128): First CDS region
atgtgcactgaaaattatgagctggctcagcaagaggcagtcctgtttgccaaacaacatctcgccctggctgcacagaatattgaacgtcagcagtttattgtgccagacattatttcttgcgtggcgcaggccgggtacttaggtgcgtcaatcccccaaaaatatggcggacgaggttacgattcttatcaactgtgcgctttgcatgaagtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagca

SEQ ID NO: 96 - protein, 376 aa, Escherichia coli
MCTENYELAQQEAVLFAKQHLALAAQNIERQQFIVPDIISCVAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCRAAVDVAARYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 97 - DNA, 1026 bp, Escherichia coli
  CDS (1)..(1026): First CDS region
gtgccagacattatttcttgcgtggcgcaggccgggtacttaggtgcgtcaatcccccaaaaatatggcggacgaggttacgattcttatcaactgtgcgctttgcatgaagtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagca

SEQ ID NO: 98 - protein, 342 aa, Escherichia coli
VPDIISCVAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCRAAVDVAARYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 99 - DNA, 1005 bp, Escherichia coli
  CDS (1)..(1005): First CDS region
gtggcgcaggccgggtacttaggtgcgtcaatcccccaaaaatatggcggacgaggttacgattcttatcaactgtgcgctttgcatgaagtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagca

SEQ ID NO: 100 - protein, 335 aa, Escherichia coli
VAQAGYLGASIPQKYGGRGYDSYQLCALHEVMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCRAAVDVAARYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 101 - DNA, 915 bp, Escherichia coli
  CDS (1)..(915): First CDS region
gtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagca

SEQ ID NO: 102 - protein, 305 aa, Escherichia coli
VMAGVHGSLENLITVTGMVSTLLQRVGSAAQKAHYLPKLATGELIGAIALTEPNIGSDLVNVETELQQDGDGWRLNGKKKWITLGQIADFFIVLIHCGNQLATVLIDRNTDGFTITPLNDMLGLRGNMLAELHFNDCRLKEDALLGPLTPGVPLAVNFALNEGRFTTACGSLGLCRAAVDVAARYIRQRKQFKRRLFSHGIVQHLFATMLTQTRSAQLMCFSAAEYRETLHPAMINQILMAKYVASKAAVDVAGKAVQLLGANGCHADYAVERYYRDAKIMEIIEGTSQIHEIQIAMNYMMGSEA

SEQ ID NO: 103 - DNA, 246 bp, Escherichia coli
  CDS (1)..(246): First CDS region
atgaaaaagcaagatatgaaagccgccattcgggaatttctttcacgctcattacgtgggcatacgttgaacgatgatgacgatattttttctctcgggcttgtccattcgttatttactgtgcaaatcatactgtttatagaaaaaaattttcaggttgagctggaagtgagtgagttgaaaacagaacagattgctaccgtcaataaaatagtggagctcattcagcgacaaacaggcctggag

SEQ ID NO: 104 - protein, 82 aa, Escherichia coli
MKKQDMKAAIREFLSRSLRGHTLNDDDDIFSLGLVHSLFTVQIILFIEKNFQVELEVSELKTEQIATVNKIVELIQRQTGLE

SEQ ID NO: 105 - DNA, 252 bp, Escherichia coli
  CDS (1)..(252): First CDS region
atgaatatgaaaaagcaagatatgaaagccgccattcgggaatttctttcacgctcattacgtgggcatacgttgaacgatgatgacgatattttttctctcgggcttgtccattcgttatttactgtgcaaatcatactgtttatagaaaaaaattttcaggttgagctggaagtgagtgagttgaaaacagaacagattgctaccgtcaataaaatagtggagctcattcagcgacaaacaggcctggag

SEQ ID NO: 106 - protein, 84 aa, Escherichia coli
MNMKKQDMKAAIREFLSRSLRGHTLNDDDDIFSLGLVHSLFTVQIILFIEKNFQVELEVSELKTEQIATVNKIVELIQRQTGLE

SEQ ID NO: 107 - DNA, 231 bp, Escherichia coli
  CDS (1)..(231): First CDS region
atgaaagccgccattcgggaatttctttcacgctcattacgtgggcatacgttgaacgatgatgacgatattttttctctcgggcttgtccattcgttatttactgtgcaaatcatactgtttatagaaaaaaattttcaggttgagctggaagtgagtgagttgaaaacagaacagattgctaccgtcaataaaatagtggagctcattcagcgacaaacaggcctggag

SEQ ID NO: 108 - protein, 77 aa, Escherichia coli
MKAAIREFLSRSLRGHTLNDDDDIFSLGLVHSLFTVQIILFIEKNFQVELEVSELKTEQIATVNKIVELIQRQTGLE

SEQ ID NO: 109 - DNA, 126 bp, Escherichia coli
  CDS (1)..(126): First CDS region
gtgcaaatcatactgtttatagaaaaaaattttcaggttgagctggaagtgagtgagttgaaaacagaacagattgctaccgtcaataaaatagtggagctcattcagcgacaaacaggcctggag

SEQ ID NO: 110 - protein, 42 aa, Escherichia coli
VQIILFIEKNFQVELEVSELKTEQIATVNKIVELIQRQTGLE

SEQ ID NO: 111 - DNA, 867 bp, Escherichia coli
  CDS (1)..(867): First CDS region
atgatgaacgtggcggtaataggtgcaggagtaatgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcag

SEQ ID NO: 112 - protein, 289 aa, Escherichia coli
MMNVAVIGAGVMGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 113 - DNA, 864 bp, Escherichia coli
  CDS (1)..(864): First CDS region
atgaacgtggcggtaataggtgcaggagtaatgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcag

SEQ ID NO: 114 - protein, 288 aa, Escherichia coli
MNVAVIGAGVMGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 115 - DNA, 858 bp, Escherichia coli
  CDS (1)..(858): First CDS region
gtggcggtaataggtgcaggagtaatgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcag

SEQ ID NO: 116 - protein, 286 aa, Escherichia coli
VAVIGAGVMGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 117 - DNA, 834 bp, Escherichia coli
  CDS (1)..(834): First CDS region
atgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcag

SEQ ID NO: 118 - protein, 278 aa, Escherichia coli
MGTGVAHNMAQYGISTNVVDISQSQLDKCRQMIEANLRLYNFHPQHKKKTHSTAEIMENIRFTTELDDIVECDLVIENITEDIEKKNALYTRMNTICGASTVFGVNTSAISITALSKLMRHPENVVGVHFMNPVPLMHTVELIRGVHTAERTLNIFHHLFAQLNKTGIVVNDSPGFVTNRAMMIFVNEAIFMVQEQIARAEDIDTLFKTCFGHKMGPLQTADLIGLDTILQSLQVLYESFNDDKYRPSFLLKKMVDAGYLGVKSGQGFYRYQQTYAEQ

SEQ ID NO: 119 - DNA, 2598 bp, Escherichia coli
  CDS (1)..(2598): First CDS region
atggaatacgcaagcgaaatgaacggcatggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcag

SEQ ID NO: 120 - protein, 866 aa, Escherichia coli
MEYASEMNGMEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 121 - DNA, 2607 bp, Escherichia coli
  CDS (1)..(2607): First CDS region
atgaagtttatggaatacgcaagcgaaatgaacggcatggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcag

SEQ ID NO: 122 - protein, 869 aa, Escherichia coli
MKFMEYASEMNGMEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 123 - DNA, 2580 bp, Escherichia coli
  CDS (1)..(2580): First CDS region
atgaacggcatggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcag

SEQ ID NO: 124 - protein, 860 aa, Escherichia coli
MNGMEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 125 - DNA, 2571 bp, Escherichia coli
  CDS (1)..(2571): First CDS region
atggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcag

SEQ ID NO: 126 - protein, 857 aa, Escherichia coli
MEIAIIGMAVRFPQSRTLHEFWHNIVQGKECVTFFSEEELLAEGVEQSTLDNPAYVRAKPYIEGICDFDAAFFGYSHKEAQTLDPKSRVLHEVAYHALEDAGYAQRTSDLITGVFVGASEDVDWLRRSLSQIGGDALNRFESGIYGHKDLLAHLIAYSLNLNGPVYSLYTSCSTSLSATHIACRSLLFGECDLALAGGITIDLPQKSGYFCQQGMIHSTDGHCRPFDSQASGTLFGDGAGVVVLRRLEDALAAGDRIYAVIRGSAVNNDGKQKIGFVAPGHEGQKAVICAACHLAEVSPESIGYVETHGTGTRIGDPIEFAALTEAFDTSHRQYCALGAVKANIGHTHAAAGVAGLIKTALVLHHRTIPPLANYQMPNSKLDLAHSPFYIPIQPQEWPASRMPPRAGVSSFGIGGTNVHMILEGLNPAVRDDHDQVRAPVFIPLSAPSFEQLDELTQQLTPLLATLDASTLAYTQQVARPVFDCRRVIQVENDGTQAMLASLDNLMPDAPWGLHCPDLRTTNDCTYAQWLAHSAHYQREATALTALLDGMNIPPAYCHAETWAAQANSSLLIRGCQTIAALKTWMNLLPTLTLLSGAGTGLLPAAAASGMIATQDVLHLLWEMEQKALHLWLPERHEPIPGYVLAWQGNPITDAQRNDRGFWSEALLADTRELGEGVHSINWVRLPPEIREDVDVLRYVAQLWCAGINVDWAVWYGTPLPQRGSASAYPFAHNHYPLPGRVMGSVETQPEAGPETHHPYQARPVLSVPFVAAHSRGMQYITGLMELLLEISPVGVDDDFFELGGHSLLVTQLTSRLERDFNVHIDLLTLMENPNPRNIYAHIAAQLGGEDNLEIACQ

SEQ ID NO: 127 - DNA, 9618 bp, Escherichia coli
  CDS (1)..(9618): First CDS region
atggataatacctctggagattttccatgtaataagatggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 128 - protein, 3206 aa, Escherichia coli
MDNTSGDFPCNKMDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 129 - DNA, 9627 bp, Escherichia coli
  CDS (1)..(9627): First CDS region
gtgatggttatggataatacctctggagattttccatgtaataagatggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 130 - protein, 3209 aa, Escherichia coli
VMVMDNTSGDFPCNKMDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 131 - DNA, 9624 bp, Escherichia coli
  CDS (1)..(9624): First CDS region
atggttatggataatacctctggagattttccatgtaataagatggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 132 - protein, 3208 aa, Escherichia coli
MVMDNTSGDFPCNKMDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 133 - DNA, 9582 bp, Escherichia coli
  CDS (1)..(9582): First CDS region
atggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 134 - protein, 3194 aa, Escherichia coli
MDTRKQLPLTPSQQGFLFHSLKDKKRSNYHEHFTCIFSQHVDSAHFKWALETLFRKHECFRTDYNWEIDERPCQVVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 135 - DNA, 9360 bp, Escherichia coli
  CDS (1)..(9360): First CDS region
gtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 136 - protein, 3120 aa, Escherichia coli
VVKTDVLPDIYVLDCEQEEIRFLLANDDIIIPVPQDDGIDAIIPQLLQADLKYPFSLKTIPVRAYLIQSTKESAFILSYHHIVMDGWSLSLFIKQLLQLYGAAVVSGVRDDSAIIPSSLKPLVDTLSARRHTFQHDYWAAYLREGTPTCIVPLSQYHTDTEAENNSYVNQTNHVEINLSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 137 - DNA, 8829 bp, Escherichia coli
  CDS (1)..(8829): First CDS region
ttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcat

SEQ ID NO: 138 - protein, 2943 aa, Escherichia coli
LSPDVCQKIQTLCSDYRITPAVIFYVAWGILLQRWCYADDVLFGATISGRNIPIDGIEETLGLFINTLPLRLRDDGATLLQHLQRMHQTLIAHYSNEHDALASIQRLVHKEGHAGDLFNTLVVLENYPVDMTLLSCASPVAIRHLSVHEQTHYPLTLTITQQKGFRFSIAYALNYLTNNMAQALLMHLSYLLEQLVDNPQRPIAALVNLSPCQQAQVLQPYLERMACRDWDSQSNVIEQFHQVAATSPAQVAVVDELCALTYSELAAQAEQLAAYLVQQGVMVGDTVGIISERRVNTVVAIIAIMLIGAAYVPISPDYPVGRMQEIIDDSGLALLLVHGKPLDALNVAQSDLCAFPVAPSVVFPVITPDSRAYVIYSSGSTGKPKGIAVAHRGLLRLIQGDSPLKVESGETTLLTCPFEFDVSVFEMWSTLLNHGKLVLLSKQALLDINHIRRTIADEQVARAWFTSSLFNSYVAEGADFFGMLQHITVGGEAVSAWHVNDVMQKYPHLVVTNGYGPTENTIFTTAYRFNGLQPARVPIGYAVPGTSLYITDLHGHLLPIGATGELVAGGVGVAIGYQNNPALSATVFVPDPFIPGGMMYKTGDYARLLDDGCVDCFGRKDGQIKINGQRIETGEIEQRLLECSGIIEAVVVPYRVRETLHIAAVVCVNDSYDEVEVRGQLADRLPPFAIPESLVVVTEIAKSHSGKADLAQLRYLLPATQCNAVSTTISEVHSDMEHALHAIWQRVLDRQDIDSNASFFALGGTSLDTIRVKGDIKRQLGLEIDITDLFKYPTLTALAHFLDTAVSPEDAIPTRAVVYSDMPVAIVGMAGRFPGAANIAALWTLVVGGESGLTLFSDEELRAHGVTPDTLKQANYIKTKGIVDDHEWFDADFFGYTPNEAECMDPQIRLLHQCCWQTLEHAGCDPATFTGAIGIYAGLLTSPHWLNAVMQDTTDSTALYKASILNIHSVTALIAHALNLTGPAVTLDTACSTSAVAIHQACIALRNRDCDAALAGGVSIEMPAYRGYEYHEGMINARDGVCRPFDSQASGTVTGDGLGMLLLKRLDDALADRDCIYGVIKGSAVNNDGNNKIGYTAPSVIGQSTVIRTSLRRAGFDSDSIGLVEAHGTGTVLGDPIELRALNEVFGPTPVPFCVVSALKSNIGHLNSAAGVAGVIKTTLALHHQVLPPTAHFRQLNPAIDLSRSALYVNQQVQPWPSTRPRRALVSSFGIGGTNASIALEAHQHEDDPSATGVRDSYLLLFSAKTPAALELRVASTLEYVKHGVGVRLPDVAYTLQTGRTAFDHRRAYLVSRGSKIDLSCATILQAEIFNGQRTTAEICFMFPGQGSQYHGMASALYAHQPMFRQHMDRCFAAFQRYSTVDLKALLFDDEDTRDIDQTQFTQPALFCVEYSLARTLIDLGITPDSMIGHSLGEYVAACIAGVFTLEDALHVIEARGRLMQSMRPGSMMAVYLSREQLTPWLAAERGIELAANNSAHFCVVAGEQAAISRLSTRLVEGGIQHRRLKTSHAFHSAMMTPMLHDFAQLLGQIPMHAPHKRFISNVSGTWITEEQATSPDYWVQQVRNAVLFSEGAAQLLVQPTLFIECGPGNTLSTFIQGHNQYSDQPTLLTLRKANAAIDDEHMLHRTLAALWVRGENIDWRRFNQTALGKHIPLPDYPFEQTYYYRYGAALSGYRQYPNPLRRPQDEWLQRVLWRMHDTSLREAFYAPGELIIIISADGDKLQQTLMSSGVDSITMPLPISSEDDVWDNDRILTHFHDICALLAHKTYRQLHCLYAPGAEAGSSLTQSLSGLYRVARWCMHSTTPLASLTVLTHGAFRVQEEDNPEPTLAALSGAVNVFAQELHPTEVRLIDIDAQSSDENLNLLTQRLAPKQETVMALRQGMLYLRRFIPTRLLAHLPPQTGCIPGNVLWIIGGEKGIGRMIGEALAQREGVRVVLSSRTGYHHEAVQQDALDVIHCDVTQAEAVRACLATLLERYGRLDGVIFAADATTTLTLHQLSESALRDTLTVKERGTANVLHALAQRNLLDERLLLLFCNSLAAVNAEIGQTGYATASAYLDALAQQLRTRYKVNALSIGLDALREQGMLLDAINGSEYDVLRGLRPLMTGTLLQAYKQQGADTSYYARLSPESDWLLDEHRISGIATLPGTGYLALAYEALRHYFVQDQICIDELVFLAPLTVMDNCSVDVFVDISPNGQGVSVEVKSMTERFSGTLTTHARGRATRLMVDDNVVCDLTGLMREMHTITPPTKELSSTHFHYGPRWHSVQQLYGNTAQTQVFATLALPTVAANDTIALHPALLDIASSVVEQLPGFHTDSVPFLYQDLRLYRPLPNTLHVALTVNRHDEEGDSYAFTLYDMAGEMVARCAAMVKRKVQLHIQDVDDDTRLRVPSADNYQLRLAAEGEGAGKLALCPTPRLALGDSQVEIEVLATGLNFKDVLFTTGLLRQQPGEAPLQLGLECAGRITRVGKNVTEFAPGEDVMAVLNGGFVQYARVESDCVVRKPAHCRIEQAAALPIAYLTAYYALVVRANLQPGERVLIHSAAGGVGLAALHIAKRCGAQIFATAGSEQKRDYLLSLGVHAVADSHDEQFAATLLTASDGQGMDVILNSLTGRLLDASLALLAPLGRFLELGSKDIVEDKALPMRFFAQGGTFIPINFHAAHGAFSRYLQQIVAWIDDNTLPLLPCKSVPLPEVARAFATLTTPQHIGKVVVTHRTAAGMDRLNAMIAERRLGGYALSMSNAEVMRQLWPILNTRSPWAQLLLSPRAIDRLARGNRVDRGVPSAANDTITQQTVKKRPRPEIGVPYSPATREVERVLCQILEEYLGLDRVGIDDNYAELGATSLDMVQLSGQMARHYPQVSVVSLYNHATVRQLATFCQPPEGESNAPSPQPAVQTNTRANQIAKRALQIAKNTARSHTSLH

SEQ ID NO: 139 - DNA, 210 bp, Escherichia coli
  CDS (1)..(210): First CDS region
atggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatc

SEQ ID NO: 140 - protein, 70 aa, Escherichia coli
MDKFKEKNPLSLRERQVLRMLAQGDEYSQISHNLNISINTVKFHVKNIKHKIQARNTNHAIHIANRNEII

SEQ ID NO: 141 - DNA, 222 bp, Escherichia coli
  CDS (1)..(222): First CDS region
atggggggaaacatggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatc

SEQ ID NO: 142 - protein, 74 aa, Escherichia coli
MGGNMDKFKEKNPLSLRERQVLRMLAQGDEYSQISHNLNISINTVKFHVKNIKHKIQARNTNHAIHIANRNEII

SEQ ID NO: 143 - DNA, 153 bp, Escherichia coli
  CDS (1)..(153): First CDS region
atgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatc

SEQ ID NO: 144 - protein, 51 aa, Escherichia coli
MLAQGDEYSQISHNLNISINTVKFHVKNIKHKIQARNTNHAIHIANRNEII

SEQ ID NO: 145 - DNA, 732 bp, Escherichia coli
  CDS (1)..(732): First CDS region
atgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaat

SEQ ID NO: 146 - protein, 244 aa, Escherichia coli
MRIDILIGHTSFFHQTSRDNFLHYLNEEEIKRYDQFHFVSDKELYILSRILLKTALKRYQPDVSLQSWQFSTCKYGKPFIVFPQLAKKIFFNLSHTIDTVAVAISSHCELGVDIEQIRDLDNSYLNISQHFFTPQEATNIVSLPRYEGQLLFWKMWTLKEAYIKYRGKGLSLGLDCIEFHLTNKKLTSKYRGSPVYFSQWKICNSFLALASPLITPKITIELFPMQSQLYHHDYQLIHSSNGQN

SEQ ID NO: 147 - DNA, 618 bp, Escherichia coli
  CDS (1)..(618): First CDS region
gtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaat

SEQ ID NO: 148 - protein, 206 aa, Escherichia coli
VSDKELYILSRILLKTALKRYQPDVSLQSWQFSTCKYGKPFIVFPQLAKKIFFNLSHTIDTVAVAISSHCELGVDIEQIRDLDNSYLNISQHFFTPQEATNIVSLPRYEGQLLFWKMWTLKEAYIKYRGKGLSLGLDCIEFHLTNKKLTSKYRGSPVYFSQWKICNSFLALASPLITPKITIELFPMQSQLYHHDYQLIHSSNGQN

SEQ ID NO: 149 - DNA, 270 bp, Escherichia coli
  CDS (1)..(270): First CDS region
atgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaat

SEQ ID NO: 150 - protein, 90 aa, Escherichia coli
MWTLKEAYIKYRGKGLSLGLDCIEFHLTNKKLTSKYRGSPVYFSQWKICNSFLALASPLITPKITIELFPMQSQLYHHDYQLIHSSNGQN

SEQ ID NO: 151 - DNA, 264 bp, Escherichia coli
  CDS (1)..(264): First CDS region
atgcgtaaagcccgttttactgagcatcagatcatcgccgtgattaagtcggttgaagccggacgaactgttaaagatgtctgtcgcgaggccggaatctctgaagccacctattacaactggaagtccaaatacggcggcatggaggcttctgatattaagaaaatcaaggatcttgaggacgagaaccgccgtctaaaacaaatgtttgccgacctgagtctggagaaccgggcgctgaaagacgttatcgaaaaaaagctt

SEQ ID NO: 152 - protein, 88 aa, Escherichia coli
MRKARFTEHQIIAVIKSVEAGRTVKDVCREAGISEATYYNWKSKYGGMEASDIKKIKDLEDENRRLKQMFADLSLENRALKDVIEKKL

SEQ ID NO: 153 - DNA, 225 bp, Escherichia coli
  CDS (1)..(225): First CDS region
gtgattaagtcggttgaagccggacgaactgttaaagatgtctgtcgcgaggccggaatctctgaagccacctattacaactggaagtccaaatacggcggcatggaggcttctgatattaagaaaatcaaggatcttgaggacgagaaccgccgtctaaaacaaatgtttgccgacctgagtctggagaaccgggcgctgaaagacgttatcgaaaaaaagctt

SEQ ID NO: 154 - protein, 75 aa, Escherichia coli
VIKSVEAGRTVKDVCREAGISEATYYNWKSKYGGMEASDIKKIKDLEDENRRLKQMFADLSLENRALKDVIEKKL

SEQ ID NO: 155 - DNA, 123 bp, Escherichia coli
  CDS (1)..(123): First CDS region
atggaggcttctgatattaagaaaatcaaggatcttgaggacgagaaccgccgtctaaaacaaatgtttgccgacctgagtctggagaaccgggcgctgaaagacgttatcgaaaaaaagctt

SEQ ID NO: 156 - protein, 41 aa, Escherichia coli
MEASDIKKIKDLEDENRRLKQMFADLSLENRALKDVIEKKL

SEQ ID NO: 157 - DNA, 477 bp, Escherichia coli
  CDS (1)..(477): First CDS region
atgcatgatgccctggtctgtggccgtcgttttcgcatgttcaatgtcgttgatgattttaaccgtgaggcattgtcgattgaaatcgatctgaatctgccagctcagcgagtggtccgtgtactcgacaggatcgcggcaaaccgtggctatccggccatgcttcgtctggataacggcccggaatttatctccctggcactggctgaatgggcagagaaacatgcaataaaactggagtttatccagccgggtaagccgacgcagaacgctttcattgagcgctttaaccggacataccgaacagaaatactcgatttttatctgttcagaacgctgaatgaagtacgggaaatcactgaaaaatggttatcaaaatataactgtgaacgcccgcatgaatcgctgaataatatgacaccggaggaataccgacagcgccattatttggccgggatctcaaaaagtgtatggaac

SEQ ID NO: 158 - protein, 159 aa, Escherichia coli
MHDALVCGRRFRMFNVVDDFNREALSIEIDLNLPAQRVVRVLDRIAANRGYPAMLRLDNGPEFISLALAEWAEKHAIKLEFIQPGKPTQNAFIERFNRTYRTEILDFYLFRTLNEVREITEKWLSKYNCERPHESLNNMTPEEYRQRHYLAGISKSVWN

SEQ ID NO: 159 - DNA, 441 bp, Escherichia coli
  CDS (1)..(441): First CDS region
atgttcaatgtcgttgatgattttaaccgtgaggcattgtcgattgaaatcgatctgaatctgccagctcagcgagtggtccgtgtactcgacaggatcgcggcaaaccgtggctatccggccatgcttcgtctggataacggcccggaatttatctccctggcactggctgaatgggcagagaaacatgcaataaaactggagtttatccagccgggtaagccgacgcagaacgctttcattgagcgctttaaccggacataccgaacagaaatactcgatttttatctgttcagaacgctgaatgaagtacgggaaatcactgaaaaatggttatcaaaatataactgtgaacgcccgcatgaatcgctgaataatatgacaccggaggaataccgacagcgccattatttggccgggatctcaaaaagtgtatggaac

SEQ ID NO: 160 - protein, 147 aa, Escherichia coli
MFNVVDDFNREALSIEIDLNLPAQRVVRVLDRIAANRGYPAMLRLDNGPEFISLALAEWAEKHAIKLEFIQPGKPTQNAFIERFNRTYRTEILDFYLFRTLNEVREITEKWLSKYNCERPHESLNNMTPEEYRQRHYLAGISKSVWN

SEQ ID NO: 161 - DNA, 366 bp, Escherichia coli
  CDS (1)..(366): First CDS region
gtggtccgtgtactcgacaggatcgcggcaaaccgtggctatccggccatgcttcgtctggataacggcccggaatttatctccctggcactggctgaatgggcagagaaacatgcaataaaactggagtttatccagccgggtaagccgacgcagaacgctttcattgagcgctttaaccggacataccgaacagaaatactcgatttttatctgttcagaacgctgaatgaagtacgggaaatcactgaaaaatggttatcaaaatataactgtgaacgcccgcatgaatcgctgaataatatgacaccggaggaataccgacagcgccattatttggccgggatctcaaaaagtgtatggaac

SEQ ID NO: 162 - protein, 122 aa, Escherichia coli
VVRVLDRIAANRGYPAMLRLDNGPEFISLALAEWAEKHAIKLEFIQPGKPTQNAFIERFNRTYRTEILDFYLFRTLNEVREITEKWLSKYNCERPHESLNNMTPEEYRQRHYLAGISKSVWN

SEQ ID NO: 163 - DNA, 225 bp, Escherichia coli
  CDS (1)..(225): First CDS region
atggaactaaaatgggtctatttacactgctgctacgataatgcctgcgtggaaagcttctttcattcactgaaagtggaatgtctccatggagaacactttatcagccgggaaataatgcgggcaacggtgtttaattatatcgaatgtgattacagtcgctggcgacggcacagttggtgtggcggtctcactctggaacaatttgaaaaccagaacctcgct

SEQ ID NO: 164 - protein, 75 aa, Escherichia coli
MELKWVYLHCCYDNACVESFFHSLKVECLHGEHFISREIMRATVFNYIECDYSRWRRHSWCGGLTLEQFENQNLA

SEQ ID NO: 165 - DNA, 177 bp, Escherichia coli
  CDS (1)..(177): First CDS region
gtggaaagcttctttcattcactgaaagtggaatgtctccatggagaacactttatcagccgggaaataatgcgggcaacggtgtttaattatatcgaatgtgattacagtcgctggcgacggcacagttggtgtggcggtctcactctggaacaatttgaaaaccagaacctcgct

SEQ ID NO: 166 - protein, 59 aa, Escherichia coli
VESFFHSLKVECLHGEHFISREIMRATVFNYIECDYSRWRRHSWCGGLTLEQFENQNLA

SEQ ID NO: 167 - DNA, 150 bp, Escherichia coli
  CDS (1)..(150): First CDS region
gtggaatgtctccatggagaacactttatcagccgggaaataatgcgggcaacggtgtttaattatatcgaatgtgattacagtcgctggcgacggcacagttggtgtggcggtctcactctggaacaatttgaaaaccagaacctcgct

SEQ ID NO: 168 - protein, 50 aa, Escherichia coli
VECLHGEHFISREIMRATVFNYIECDYSRWRRHSWCGGLTLEQFENQNLA

SEQ ID NO: 169 - DNA, 50755 bp, Escherichia coli
  misc_feature (1)..(50755): first misc_feature region
tgggaatgtttgccgactgggctgtgcgggccgtgctgttttactggcgaatggttactggacgttggctatggaaataccctcgatccgagccgcaaaagtgtgaaaaaaagccagttgtatcggaataaacgacaaaatgcagattatttcagcaaacgatttcaaatttaaaaaacaggctttgacattgtgggtgggcatcgctaatattcgcctcgttctcacgattcctctgtagttcagtcggtagaacggcggactgttaatccgtatgtcactggttcgagtccagtcagaggagccaatttcctgctttcatgcatccttgcgaatccttatgttatttttattcaacaggttagcgtgaaaactcttcccggtgcattttgattttaccctctgcatcgggaaaaattggtagtcaaatctggggtcaggttagttcgataatggagtgacccccattgacttatgaataatcttgtaaagaaccaggccgtatcagcaaacgctgatacggcttttcatccacaggccgtttttcatcttctaagtcgtccaggacatcatggttcttaatacacatgcgttcgcatgtgcttatgttaagtagacttattgtcttacacattttatccgtatcattaaccagaatatgttccggagcagcgggtgatagtgccgccagtccacactcatcgctgcccggaaaaatcatcagtggggaggcaaacggtaagcaccccgctaatctattgctccttgtatagttacacaactatttctaccctactatttcgagtgattcaatcgtctggttcacataacctaccacctgttcaaaatgcttatcgacaaaaaaatgatcggcagcaggaaatataatagtccgcgtctttcgtgtggtgaatttttcccatgcaagtaattcatcctgcattaccagattgtcagcatcgccatgaaatagcacgatcggacaggttaatgtgcgcgccttggcctgaaatacatactgctcatagagccgataatcgtttttaatgatgggggtgaaaattgtcattaactctttattacgaaagacatcaaccggagttccgcccagcttgacgatctcttccataaacgcctgatcgggcaaggtatgcagtattacttcatgagaggcccgatcgggtgggcgacagccggaaaaaaacagcgcgcatggcatgtcatgtccatgatcgagaatataatgcaccagttcgaaggccatgatccctccgagactatgcccaaaaatggcgtagtctccacctgtgtagtgtttcacaaattgttgataaaggtcagcgacggcatccaccatcgtaagacacagcggctggcgtattctagttcccctccccgcaggttctaaaggccgcaaagtaatattgtccgacagcacgctacgccatttataatacatggcggcagaaccacctgaatatggcaaacaatacaaactgatattactcatcgtcccactccttgttgtgtaatagaattcgtttaatttgatgatttaatgtcagaacgaaagctaacaggataattccgaacggtatcgccaacacgctcgatggaccccataccaagataaaacgccagtcaagtcctggagatagtatacccggtgcgacatagagcatggcggccacgagcccaggaaccgccaaggcgatgatatagtcacgtacgcgtaaacgtaacctctgctgttttccagggccatgcgccgttgcgcgataaacacggaaagcaccgcgcactacaaccaccgccccccaaaaacacagcaacaacgtgaggtagacgaaaagggtatcggtggctgtaattgcatcaccagcgccgtcagcatatttgccaatgcgcagataattatcgatatccgcgcaaagctgtagtatcagattcgaattcatatttgccagcgcaacaatgccaatctgctgatccggtcgcaacgcaatgcaagaagaaaagtttggattctgcccaccgtgactgatgtaagggccttgattctggtcgataaaccaaccgctggcatagaggatacgattgtctgcggcaagcggaacatcactattaccacgccaactgttactcatcgcctcacgcagcgttgccggcaaagcctttctgtgcaaccaggcgtctatccatatttccatatcaggcagagtgctatggatataggcggcaggaacatggttccgggccagaggcgcatgaaacagaacgggtttgccgaatcccagtttatagccgcttgccttgttgacaataatctcatcccccttaactgccacagtcgccgacatgcccagcggctgcgtgagtcgttccgcaatgacctctgtaaaggtttttcccgtcacattttcaatcaccgcgcccaacacatcataattggcggaggcatagctaaacttcgcacccggcgcaaacagcagattctcgttgcgcagttgctgtgccacagcgctcccaggcatagggttttccagccgagccagtgttgaaaaaggcaatcctgatgtatgataaaggaaatcagccacggtcagggaagcaggttttccctgataattcaagcgcatttccggcagataggtaatgatatcatccccttgccggagtctgccttcctgaatcagtatttgcaccacaagtccggtaaacgccttactcatcgatcccagctcgtaaactgtgtctagagtattcgctttctgactagccacatcggcaacaccgtagacaaatcgctgacgtacccccttaatggtcacacttacggaaagggctgggaccttggcctcctgcatccgttggtgaattaatgtcgacaggcgctcatcttgcgccccgataggctcatgttcttgcgccaaagcgcacatagcggaaataaagagcagcatacagcacaggagatgatataatgttttaatgctaacgtgttccattattgtcatcctgtgaacacctcataaaataccatcaacacattcggagataaattcactgtgctcacggatagcgggtctggcataaatatcggcggcagtcagtccgattttataaatgtggttacagctgtcgacgaaagagataacgtgcatcgaggtcgctccgtattcgaaaataaccgcgtgttcgtcataatgatcgatgcataacaatgaacgccaggttttctccacaaagtcgctgaccgacaaataactcactggtaacatagcgttctctctcgcatcactggactgaatttcataccggacgcgatcaaacgaataaccgggtaagcctatagtctgcacggctggcatttccggtaaacaaatagtcactcctcgttgccaaagagtgcccaacagcggcaggatgtcctcaggcgtatccgtattcagcatgggggaaaatactgtttgcccaacccactgcgcatgctggtgatacaatatggaaaacgtccccgcgcgaccgatttccagcatcagcgttccctccgtcaccgccagattagccaatatttcgctcagttcactgttgccggccagcgtctgctccggtgtcgtttcagccacaatcacctgctgaacagcgttttccagtgagatgatgcgcgcaacatactgcgctgctgcagcccccgtcaggtaaccgatgtgctgcacaggcgagatactttgttcgatcagccattcactaagactcacctgctggataaactgacgcaatgctggcgtccaatcggctggttcgcagatttgtgcaacatcctgagacaggcgctggtgccgctggcgcaagttaggttgacaagccagcaaatgcgtcagggcactctccagcttatcgtcccggtccggatataggaacaccaaggtagtttccatattgataggggtaaaagacatgtcagcatcccgcagtttcgccaaacttgcacgcaacgctaccacactgtctgccgccagcgcacagcgatacgggaaatgtgcccggcgttgcgcgagagtataggcgatacgatctttatctgcttccgcataggtcgccagagcgtgataatgagcatccaactgttgtctaagggctaatggcgttttggcgctgaagaaaaacaggcggcgctcattttcttgcaccgcttgcgcaggcgtctcgcaccagttttgcagaaccaaatgagcattggtccctcccagcccaaacgaactaacggtggcatggatccttttcgtttgtgggacagaagtcactacatcactgagataaaatggcgaggctggctgcaacagttttttatgtttatttactaggttgatctgcgggggaactaaaccagtatatagcgtcagtgcggttttcattaagctgacgataccggaagcgactcccaggtgacccaagttggcttttaccgcacccaattgaatgctgtgcggcgcacatgccggtgcgaaaacccggtgcagagcttcaagctcaatctcatcacccaacggggtaccggtaccgtgcgtttcgatcagtgcgatatcagtcggtacgacttctgcggcggcaagcgccgtattgatcgcttctacctgtccttctacgctgggggcgacaaaccccagccgacgcccgccgtcgttatttaccgcacctcctttaatcaccgcatacactctgtcttggtcgcgtagtgcatcctcaagacgttttagcaccacaactcccgcaccgctgctgtataccgtgccggtcgcctcagcgctaaacggggcgcagtgtccgtcttgcgataccagcttatcaccttgcggactgtagccgtgcgcctgtaaaaaacccaaggtgaccccacctgccaacgcaacatcggcttgaaaagtcaataacccctcgcatgctaaatatgctgccaccaacgaactggaacaggcggtctgtacactcacagcgggtccggtaaaccccaacttgtaggcaacctgagcacacaagtaatccttttcgttaccaatctgcgcctgaagataatggtgatcgccgctcatcttcaggtatggatagacgcgatcgataaaatagttattggcgtaggtcgccccatagacgccgactcgcttaagttgcgtgggaatatagcccgcatgctcaagagcgttgtagcagcattcaagaaatattcgttgttgcggatccatcaacagggcttcgccaggcggaatattgaaaaatgcagcatcgaagtcatagggagcggtgattatattgcgcagcctaatccaagggttcccattatcgtcttctgtgcatgtcggttgagtgaactcctcacccgccagcaacttatcccaccactcgggcaccgattccgcaccggaaaaacgcccgctcatgccaataatggcaatatccagtgagccacaggtaaaatcatcctttgccattgttgtattccttaagggttggcatcgtgtttatagtgtccacaaagtcggcgcgcccgtcagcgtggcgctgtgttggcacagccaggcatccagatcagtgaggctgttcttgtagcgcgccagcaggagttgcacatcattcagcgcaatgcgcgtgggatcgaaacggcagtggaaggagagaccatcagctgccgagcgcgcaatattaaactccagcacgcagccgagcgcgttttcaggcgcggtatagatatcactattaaagtgatcaatatgaaaatagcggagtgaaggttgcgcctgcacaccgatgtaattcattcggatcccttgcgcaagagagtcttccggtgcatgccgcatttgcagcagaccgtaatctcccccaccatgcgtgcgttttgccaaatcggaagcgatcgcagataacagtgtcgccatatcgccatgcagagggatcgcccaaggataaaatagagtaaaccacccgaccgtatccgcaacgtcaggctcatcgggccagcagccgcgtcccatgccttccatctcgatgcgacaccaaggctcttcgctgtagtaacgcagcaccagcgccaatgccgttagcacataggtttcggcgctgtacgcggtattaccactggattcaaacaacctcctgacgcaaggatggcgaaagtcttcacgccaagcgcgcgtacgaggtaatgagtcatctggcaatgacacgggtgggaaatgcagcggtagcgtttgacatactgtgcgccagctttcgtgtgtggcggaatctaccgttttgctcgccagatagtcattccagcgatgcagtccgctgttgctggtgccattgacagtgctgacggcgtccagcgtgctgaggattaaataccaagagtgcatatcgacgcacaagtgatgggcacagagtaccagcgtgctagacgcaggctgcggggcgtgtaacagagctgccgtaaagactcgaccatttgtcacgtcaagcatgctattgcactgagcgatcacctctgccaacgtccactgcgccgtcgaatattccgtgagcacctcgttgggataacacacattagggtcgcatactagcaaccgcccctcagcgtccagcgcactgtgcaaagctggctgctgctggattaatgtatgcagcctgttgtgtaactgctcgagcgggcagcccggcaacactttcagcacaatgacatggttataaacattgggcactggcaacgccaactgcgtaaaccaacgcaatgcgggtagatcgatacgggtgttatgagcatactgcgcgagctgtgacaccgttgtatgactagcgagaaactcacagatggcgttcactgttccacactccatcacctgcaccgctgacatcgtccagccgtggtgcctgagctgcgctgcaatctggatactcttgatggagtccaaccccaagacataaagattttcgttatcatcaaactcagtttgctccagcgccccttccacacatacccgaactgaatgccttatcgccgcatctcccagccgctcgctacccgatgcaggcgcggtgtttcggaccgttgcgaccatctgacgcacgtccaccttgccattgtgcgatagcggcagttgggcgatagcacagcactgcttgggttgcatgtaggtgggtaattgctgacgcagatgttgcattacggtagctacatcaacagatgacggtgtcacgcaggctagcaacccgctgtgctgcccctgcacatcatcaatcaccgccaccgccgcactttctacctgaggtgcgctcaacaacgcttgttcgatttcgcacagctcaatacgatagccattaattttgacctgatcgtctttacgtccctgataaaccagcgtattaggagcgatggcgtagccaatatcaccgctgcgatagccaatcatcaccccattggtatctttaaggtaggcggcggccgtttgttgcggcgcatcgatatagccctgcgtcactgacgcgccataaatcaccaattcaccagtttcgccttccggtaccggacagccccaaggggagcaaattgctacctggcaaccgtcgatcgccataccgatgggcaatgaaggcagcgtttcttgcccggtgtagcgatagatcatgcaaccaacggtggcctctgtcggcccatattcgttatagatcacggcctgaggaaagagagcagccgccttacgcgccagatcccgcttgaaatcctccccgccaaccaccaaggtacgaatctgctcactgcttatgccagccgcacacaacaaccgcaggtgtgcaggcgtcagtttgatcactgtgttgggctgatcaaccacggccatgcgcagcaatgtttcgctctcggcgtgccgacaaacgctgatgctagcgcccacacataagggggcgaacagcgtagtgatggtcaaatcgaaggacagcgaagagtagagcgcagcccggtcctgcgctgtaaagtaacgttcggcggcgaaatggagatagttagccagattgccatgagagacttgcacgcccttaggctcgccggtcgatccggaggtaaacagcacatatgccagatcctgcggttcaatagctggccaaggttctctagcaagcgccgaagtggctaaggcctggagcaagctggacgcgggaaacgccagcgcctgcgtcaattcatgcatcgccggatcgtaaaggatatgcgctacctgcgctttacgacacatggcgtaaaggcgggtcgttggcaacgcgggatttagcggcagaaatgccgcgccgcagcgcaaaataccataaataaccatcaccgtttgagcgctatgctcagcgataatcccaaccacttgaccgcgtccgatcccctgttggcgcagataacgcgcaacccgctcaacagcgtcatccaactgccgataagtcaaagactgttcattatcaattagtgctgtgcgatcaccatgctccacaacttgcgctgcaaatcgggaagtaaatgagggtttgagtgagccacatgccaatgcgacgtgcggcgcaggatagacttcgagatcgcctagacgagcgtcaggttgccgatccaatgcagtgactaaatccaacagcccatttttcatcgctgtcagttggtgcggagtgaaagcgctacgcagcgcctccagactcaacctaaggctttctttatgattattaacagtttgcaaaacaatctgtagcttataggactgctcgccgctgtagtaactctccacgcgttgcgcggcacctgcaatgtggcgttcataggtaaagttataataattaacgcaataatcgaacgcccgcaacttccctcccccctgttccgccaaatcctggttgaataaggtaatgggatatttgctgtgtttaaaaccgcgtttcagttcgcgctggaaaaaggccacccgttcacagaatcgttccgtgcgcaccagtcgataggccagcggcaattgattagtaaacatgccaaagcaacgccgcgcctcgcgagtatgccgattggctaacggcacgcctattacgcctttttcctccccccatactctggcgcgatagagagcgaagagtgcaataaacagcgtattaagcgtacagccataacgattacacaacctgtagagacggttaatcatggctggctcaagccaagtggaacaactgatgccctcagtagtaacgatgggggaactgtctggaaagcagtcgcggtattcgtcgatatagtcacgccaccagccacgatcaacggcaaagcgcgttgacgcctgataagattgctgctgcgccagaaatgcgctataggctggtgacgcatcatctggtacgtcctgctgttcgtatgctcgcttgacatggtttgacaacaacgccattgaccaaccatcagcaatgccgtgatgggctttaaataaataaccgctgtattgttcaccgcacgtaaaggtgacaaactcgaacaaatcgtgcgccagcagggtaaagggctgccggaaccactcatcaacaaatgtttcgatcgccgctgggcgtaggttctccttgtcataatctggggaaaaagtcaaatggcggatatcgcgccagtgataaggctgcacttggctgaccacttcactctcctctcccatcacaaaccacatacgcaacgcatcaaattgccgaatggcggactggatggccgcgtgtagtcggggcagatcgacaattccctcaatggtgaccacaccaccaatgatgtttacggcactgtaaggatacagttgatcaatgatgtggcactgttcctgtggccacgacaacggattgcccgacatcaacctgctccttattcattaaatgcgccgcacctttattggcgctgtcaccgatatccgcctctagtacccttccggtaccgtgaatccgccactgatgctttcgcagaactcagcaaagttaatcgtcacatcatcgtgaaaatgcccggaaatgatctgtatgccgcacggaagctcatccatcgttttcgccaatgggtaaacggtggcaggcaaaccaaaaaccgttgctaacatgttccagaacaaatgttcgttgtaatcttgcggttcgccattgacgataagcttgcgcttacgcaccggctgctgcatgtgcgcaaacgccagcaccgggctgacaggtgtcaacaacacgtcataacgcgcgaaaagggtttctatcacccggctgtattcgtggcggagtttgtctgtattccgctgttcgccactgtctttcagcatgccctggtaatagctcgttatcccctcaggcacatccgccagcttgcccacaagcctgaagcccagcgcagccagcccggctgtaagacgctggcgtccattgagcgccgtacttaccagccgaccactgagtttgactgctatatcaaacagtgcgtcgggatcgatatcggcgggcatagcatcatcaacctccacgccaggctgtgcgcgtaacttgtcgataaacgattgaaaacgctgtgcgatctgttgatctatctcatggtggggcgcactaaaccacgtgcacacgcggtagtttgctttggcctgataacggctaaaatcgggaatacgcggcggttccacccagaatgtgctcaatgcgcgcatcatcagacgcagatccgccgcgctgcgcgccatggggcccgccgtcgagagatccggctcatcagtcgcttgcggaccaccaccgggcacatgtcctctgaccgacatcaaccccaagctacaacgatgggcatagacacctgtgtagtgtgcgggaatgcgcagtgagccaaacaaatcgctgccaaattccacgggggtgaaatccgccgccaccgccaccgccgctcctccggacgatccgccgggtgaacgttgcctatcccacaggttatgggtggtgccatacagatcgttataggtttgccaatcggcagtcatcatcggcacattggtttttcccatcaggatcgccccggcagcgcgtaagcgtgcgatggaaggagcatcctgcgtcgcccggttatctttcagataatgggcaccggacgtggttaaccacccttgcacgtcaaacgactccttaacagtacaaggtaatccgtgcaacacgccccttgcgcgcccctccagtcgctcacgatcggcgcgcgcggcggcctccaacgccaacgcatagtgctgctgcaccaccgcattcaacggcttgttaaactgcgccatacgtgaaaaatagtgattcaccaacgccactgaggtggtttctccggacgccaactgtgccaacagtgtccctgcgctacgatagctctgctcactcatcgcccttttctccctgttgggcacgtttacgccgcaacgccagattctcgcgcgcagcgctgacctgcgaaacctcagcctgcgctaatacgatatcgtgggcggcgggtagattgtgcagttgctcatcaaggtaacgcgccacatccgcgatggttggcagacggaacagatcgacaatgggaatctcctgcccgataatcgcctcaagtgcctgctgaatacgcaccaattctatagaactgccccccagcgagaagaaatcgtcttcggccgacacgtggctcacgccgagtacctcctgccagagcgccaccagccgctgttgtaacgcactgtccacctggattggacccacgccgtcacgctggtgggcaatttgttcgccctgcagctgtaatttttgccgatctagcttgccgttagcggttaacggaaaatcggtcgctaacatcagatcactcggcaccatatagtcaggcagttgctgacgcaggccgcgcagcatggcatctttgtagctctgcatgtccagcggcgcagcggtttccttcggtttctcataggtggagaaatcgcgcagcaatgctgcagcacttgccgcctcttgccctatcgcgccccccacggtgcaatggacatagcgatgatgtggcgacaattgaaaatgcgatgccacagcggaaaagtctgccatcccaagttggcacagccccaatccgtagcgcggcgcatcttcttccagtaaatggcagagagtacctgcttccatcaccgagaagtgccaagctgcctcttgcccatagaatggcgagatcaccgccatatcagccaccataaacagcgtgaatgccgcccgatcggcaatagactgattaggtccggcatgaaaaccactgttcagctcgacttctggtgctaccggcataagacagctctgtcgcgggtcgaagtagtaaataccggatactccctcttcgatcttgtctggatgcaggtacacgtaggtttgcaccgggtatagccccccggcggacgcataggcatacttggcaaaaggtagaccgggtagacgcatctgccccaagcccgacagcaattgccccaactgtgccagcgtggttttttgcgcgctgaaatgacgatagctgcggcgtttgatgtaacgtgtgctatccgccggtgccgtcagtgcaatgcccagaccatccagcgcgcgaatatgtggctccttgagtttgaacgctagacgctgtgccggattcacaataataccctgcgccagtgccgccgcctccgcttccttagcttgcaatgcctgcgcctggtggcgatcgtgcagtttggcaaaagcgaccagccgacgatgttgagaattacccactgccaccaccactgactgctccacatcgggatgtcgcgcaatgcagcgctcgatttcccccagttcgatacggtaaccattcaccttcacttgggtatcgttgcgccccaaaaaggcgacttgcccgtcagcaaagtagcgcccgcgatccccagtgcggtaaattcgctcaccactcgcttcgcgccagacaaagctcgccgccgttttctctgcgtcgttcaggtagccttgtgccagccccatcccgccaatgcaaatctctccttccaccccgaccggacattcctccagttgcgcatttagcacgtatactggctggttgcgcaggccccgaccgtagggaatactggtccacgtcgattccacctcacctatcgggtagtagaccgaccagatggcgcactcggtcgctccacccagactgatgatgtccatcgtttcattgagccgctcgcgcatctgctccggtaacgttagcgggatccagtcgccgctcaacagtgccagacgcaacgtcggataactcatccgatcgccgctgtggtattcgcacagcatctgcatcagtgcgggcactgcattccagacgcttacatgaccgtgtgccataactgtctgccaatgacgcggatctttttcccgtcctgcttccggcagtaccagcgctgcacccaccataaaaggcgcaaaggcatcgtaaaccgacaggtcaaagctcaatgatgacagcccgaacaccctatcctgcgcattgaggccaaagcgttcgttgatgtcttccagtgtgttcatggccgcacggtggtcgatcatcactcctttcggggtaccggtggagccggaagtgaaaatgatataggccagatccgtgacatccccagccacttcaggcaacggcgcagcaggcgtgtccagcattccgtcgtcgatgatcagcacgggcagcgacggctccaattgcgtgagacccggctgcgttacttgtacccgcacctcgcccaccgtcagcaaaagctggcgacgctgtggcggtagcaccggatccactggcagatagaccgcacccagtcgtaaaatgccgtgtacggcggcaatctgctgccagcctttttccatcaccaccgccacgcggtcgccatgctgcacgcccagcgctaacagggcgcgggccacatgatccgccgccgtcgacagttggcgataggtcaattcacggataggactgatcagcgcagtttcctgtggcgtcagtgctgcctgacgcagtaacccatggtgcaacaaggccgtaggtgcaggagcctgcgtgaccggtgcactaacggtgggcagcgccagcacatcttgagtctcatgccagagctgtggtcgctgggctagggcgtgcaggagttggcaataacactggaacatctgatccattagcgccggttcaaacaattgttccaccacgtcccaattaaagtgcaattccccgttacgctccattacctgatgatcgagccacacctgcggtgtctgtgaaatactgtacagatcatcctgcggttggttgaacagcgtatcatccgtttcccagctcgcctcatattgattgagcaagctggtgaacacgataggaatcaccgatttcgccggatcgcggtgagtttgtaccagcagtcgagagacctggataccgccaaacaagcggttatccaaatcgcgccacagttgagagtggatcacgtttgcccgcgcctgcaaggtttctccctgcgacatatcaatctccagcaacgtcagtgcagtaaaatcgccaattaagtgattgatatctgcgtgcaacggcagacgattaaacagcgtcaggttaaggctaaagtgcggcgaggaactaaagcgcgccaacacctgagcaaaccccgtgagcagcagtgtagtaggcgtgatactcatctgacccgcctgcgttttcaagcgctgccagatagcacgagatagacaatagctacggcgcacgaatgtggggttttccagcttcgtggggtcggtacgcagcggcaatcgtggccccggcggcagagtttcgatgcgggcgcgccagtagtcacgtgcccgttcaaactgcggcgttttctcgtaggattttaaggtcagcacatagtcgcggaaactgtacgtcaatgtaggcaatgccgcctgcggatggcggtagtgataagctagttcccgaatgaacaactccagactccatgcatcggctatcagcaggtcgatagatacatgtagccgggctttttgctgcggatcaaccacgacctccatctgaaacagaggccagcgactacaatcaatcatctgatgtgagagggtgtcacgcagctcacggcaacgctgttgaaacgcatcctcgcactgggtggtatagaaggcaacgtggtattccggcacgtttggcaatatctgctgcataccgtcatcgttgacaattgcacgcaacatgctgtgccgcgcaatcaccgcattgagcgcgcggttgaacgctgtttcatctagcccctgtagttcatattccacatagatatgggtggaaatattgcccaatcccaaggattttcgccgcccaacccaataggcctgttgcacgtcagtcagcggaaaaggtaggtgctgctggtcaggggcaaagaccgtatcaggcaatgctgaaaccgctgtctcactgccgccttgttcgagcagatagcaacttaatccctcgatggtgggatcggcaaagaatgcgcttagcgtacaggtgatgccgtaacgttgctgaatatcatataaaatggttgacgctaacagcgaatgcccacccagttcgaagaagctggcgtggtgatcatcaatgctgacaccaagcgtgcgttcccatatctccgtcaccactgcaataatatcggattttgttgcgcgggataagagattattcgacgattcgtgggagaacgtggcaggccgtacggcctcgacccaatagcgctgcggtgtaaaaacggtccccggcagggcgatgcgttgactgcccaacatacgctccgccgcatccacccagcgccaatctaggctgacgccagccaaccataactgccctaacgcctctagcgcggtgcgattggcatcactcgccgcgtcgtccagcatcaaagagcagacatcgggctgcaagaggggattcgtcggcacatcatcaaacggttggcccgcattcaacctgtgccatgcttgctctagtgtgcagtctcctcgtagtacggcggcagcatagccaccatcaccgtcgccgcatagcaccacattcaacgtttcccgttcgtcaatcaacgcgatcagcgcatactggctgataaacgtccgttgcgcaggggagagatcttgcagacaggctggttcgagcggaaaatgctcgagcagttgtcccaccgcctgtgacaacacctcagagcacgccagccagtcactaagcgtctcgagtgcaacaacgaaacggtgccccaatctccagtagatcgtgcaacccgtggttgcctccaccatcggtgcgtcgcggagttgtcgggctagctgggtgcaattctctgcgatgacacacttacgtaccggggcggagaaacgcccgtgacgcagggtgtaagccacgtcctgtaagcgtatctctggatgtgcggccagtttcgccagcagggcgttttgcatctgttccagggcattgtggttttttgccgagagtacaacgacacaaggccccatctgctgcgccctcgcctgcggcgtcgataacggcgcttgtaccaccagatgtgcgttggtgccgcccaatccgaacgcactcacaccagcggtgcgtggcgtggtgccctccggccaaggcgttaaacgggacaccacttcaaacgggctgtcctccaaccccagttgcggattagcccgttgaaaattcagcgtagggtaaaacacccggttagtaagactcagcaccgtttttatgagactggtgatgccagatgccatttctacgtgacccacgttaggtttcacagcccccagacgccacggtgtcgcattcggcgctggcgtcccaaacacacgtttgatggccgcgaattcgatagcgtcacccaacggcgtgccgctgccatgcagttctagatactgaatttgctgcggcgtcacctccgccaagctatgcgcctcaatcatcacagcttcctgaccatcaacacccggcacggtataaccactgcgcgcaccgccatcattgttgatggcgcttcccttgatgacggcaaggatgttatccccttgcacctgcgcgtctgtagcccgtttgagcagcaccatgcccaaaccactgctgtagaccgtaccgctcgcctgcgcatcaaaagtatgaatcaggccatcctctgcttgcagcccatcaccgtgcgattcatagctgcgctgctcctccatgcgaaacgtgacgccacccgctagcgccatatcgcactgaccgctcagcagcccttcgcaggccagatgcactgccaccagcgaggtggcacaactggcctgaaccgtcacgcaagggccggtaatattcaggcggtaagccagttgggacgtcaaatgatctttgtcattgccgaccatgatttggagaccaccgagttgtgcaagcttgtctgggttgttcatcaggtgagtaagcaaatagaagctggtactcacgcccgcatataggccgacgcgcgcatcgtgctgcttcgggttgtaaccgctttgttcaaacatctcccaagcacaggtcagaaatacgcgctgctgtggatccatgatttctgcttctgcacggctgtagccaaaaaagttggcatcgaactccgccatgtgctcatagacgttgttcagcgtaatgtgattgtggccgttgctcggggtcactttggggtccaaaatgttgcatccggtgcgaagcaccgtttcgaatgccgcaacgctgtgcacgccggggtaccggcagttcatgccaacaatggcaatatcgctttcactgtaagtcattagtttttccttaacgctgacgctggtgacgacgtacaagtcgttgctgggcgcgggatcgggaagcatcacgctgctgtgtttgattcaccgcccgtgcattgtcctgcatagcctgcaaataaccggcaattcttttcacggtggttaagcgaaatagctcagcaataggtaccgtaaccttaaaaatctcctcaatacggcgatgcaacagcacgatctggattgagccgccccccgcttcaaaaaagttgtcattcagtccgatctgttctcgttgtagtacctcgcaccagagagcggccacctgctgttcatagggcgaggcgtgcgcgagggccctcgacttctgtgatgtagattgcgacatacgttggataacctcttgaaccattgccgcctgatcaattttgccgttgcctgtcatcggcagcaccttgagaagaaagaaatgttggggcagcaggtaatacggcaactgcacggctaactgagcacgaacacgcgctaacagggcgtcagtatcgtcaggatgcaggttttctgcggcagtgataaaggcatacagctgtccctggtggcacaccacggcggcactccctacgctgtcgagctgttcaaggtggcttttgacttcccccagttcgatacggtaaccattcaccttcacttgggtatcgttgcgccccaaaaaggcgacttgcccgtcagcaaagtagcgcccgcgatccccagtgcggtaaattcgctcaccactcgcttcgcgccagacaaagctcgccgccgttttctctgcgtcgttcaggtagccttgtgccagccccatcccgccaatgcaaatctctccttccaccccgaccggacattcctccagttgcgcatttagcacgtatactggctggttgcgcaggccccgaccgtagggaatactggtccacgtcgattccacctcacctatcgggtagtagaccgaccagatggcgcactcggtcgctccacccagactgatgatgtccatcgtttcattgagccgctcgcgcatctgctccggtaacgttagcgggatccagtcgccgctcaacagtgccagacgcaacgtcggataactcatccgatcgccgctgtggtattcgcacagcatctgcatcagtgcgggcactgcattccagacgcttacatgaccgtgtgccataactgtctgccaatgacgcggatctttttcccgtcctgcttccggcagtaccagcgctgcacccaccataaaaggcgcaaaggcatcgtaaaccgacaggtcaaagctcaatgatgacagcccgaacaccctatcctgcgcattgaggccaaagcgttcgttgatgtcttccagcgtgttcatggccgcacggtggtcgatcatcactcctttcggggtaccggtggagccggaagtgaaaatgatataggccagatccgtgacatccccagccacttcaggcaacggcgcagcaggcgtgtccagcattccgtcgtcgatgatcagcacgggcagcgacggctccaattgcgtgagacccggctgcgttacttgtacccgcacctcgcccaccgtcagcaaaagctggcgacgctgtggcggtagcaccggatccactggcagatagaccgcacccagtcgtaaaatgccgtgtacggcggcaatctgctgccagcctttttccatcaccaccgccacgcggtcgccatgctgcacgcccagcgctaacagggcgcgggccacatgatccgccgccgtcgacagttggcgataggtcaattcacggataggactgatcagcgcagtttcctgtggcgtcagtgctgcctgacgcagtaatccatggtgcaacaaggccgtaggtgcaggagcctgcgtgaccggtgcactaacggtgggcagcgccagagaactatttaccccccaccaactttgcggcatggcaaccagcgcctgcagcgcatgacaataagcaccaaacatctgatccagcagcgtggtatcaaacagttgctcgaccgcgtcccagttgaaatgcaactccccagccaactcgatcacctggtgatcgagccacacctgcggtgtttgggtaatattggcgtccggacacagagtaaaacgggttgtgtcccgagggtcttgcgcagtcgtctccccgtcgatatccaacatactagtgaataccaccggcatcggcgcatggaaacgaccgctatggatcagcgcctcgctggcgcggatcccactgaaacgacgatgttcgagatcttcccacagttgcacctgaatacgctgagcgttgtgggcataagagtgctggctgtcgtaacaaacattcagcaagctgacagcggtaaaatcaccaataactgcctctgcgttggggtaaccctgcgggcggttgaacaacgtcagattgagcgtaaacgtcgggctaaggctccaacgtgccagcacttggctaaagactgtcaacaacaatgccgtcttggtgatacgtgtgcgttgggccagcgcgctcagcactccccagttgtgggctgacagccgatgacggcgacgtacgaacctgatcgcagacagttgcgccaaatcgccctgtacgggcagcgttggtgggccatacagctgcggcagcgcccgttgccaataggcctgatcgcgtgcataggcttcactcgcctgctctaccaacagcgcctgcacgtagtcacgaaaagagaacggtagcaacggcagtgacacatggggctcacggtacagcatcatcaactcctgctgtagcgtgcgcatactcagagcatcggcaatcagcagatcgagactgaaatgcaagcggccatgttgcgccgtgcaagccgaataactgaaatcaaacagcggccaacgatctgcgggatgcacatgatgcgacagccgatcgcggatcgccatcaaggcatcgtttcgtgcgttaggggacaaagcactcagatcgcgctgctctaactgatacgccggcacttgcgccagaatctgctgagtaccgtcggggagtacccgcgcacgtagcatttcatggcgagcgatcagcgcattcaccgcatgggtaaaacgcgtaacattaaagtgttctacgtcaaattcatggtagatgtgggtcgcgatcgaggtagcacccgtctgtcgtccaagccagtaggcgcgctgaacatccgtcaatgggaacggttgatgacgatgctcagggtcgtgcactatcacccagtcatcctgagacgcggcagcgtccgtgatagattgctgtgcaatacgcgcactcagtgcccgtagtgtggagtagtggaaaatgtccttcagggtcaaggcgcagtgaaaagtgcggttgatctctgctaccaacgttaccgccaacagcgaatgtccccccaagcgaaagaaatcgcactcaggatcgacgttttttatcggcaaatagcgcatccacagcgccagcaacatctgttccgtgtcgctcagcgcttgcgtctgcggcgacacaagggagctatcggcaacgaaattttccgctaaccgcttacgatcgattttaccgttgtcagtgttcgggaagtcggccaccctctgccacagcgttggcaccatatagtctggcagttgctgccgaagctcgtttttcagttgctcgaatagcgagggaggctcactggtgatgatgaatgctgccagtgctttgtgtaacggtgctctttcaatacaggccaccaccgcggcgtccacatgcggatgccgtgccaacgtccgttcaatttcgcctaactcaatacgataaccgcgcagtttgatctggctatctttgcgcccaacaaaaaacaactgcccctgcgcatcactcctgaccagatcgccagtgcggaacatcctgccaccggggacccctggttctgacaagaagaactgtgcgttcaactcaggctgcccatcatacccttgcgccacaccatccccggcgatgtaaagctcgccgtcaacgccttgcggcactggatggccctcattgtccagaatgtatatacgggtattggcaatgggagcgccgagggtgatgttttccgcttgggttatctgcgatttcagcgaccaaatggttgtttcggtgggaccgtagaggttccacaatgaaccacaacagcgcaacagttcttccgccactttcgttggcagcgcttcaccgcctgccagcacacatagttccgggtcgccacgccaacccgccatcaacagcccgtgccagaacgagggcgtcgcctgcatcagcgttggtcgatagtcggcaatcagcggaatcatacggaagctgtctgcggcgcgttccgcctctgtcagatagagactcgcaccggagatcagcggcaacagatactccaagaatgagatatcaaatgttggcgtcgtcaccgagagcagccggtcttgcgagccaaccgcaaaggtacgctgcatatccaacaacaagttcagcaacccgcggtgaacaacgcacacgcctttaggttcaccggtactgccggaggtaaacaacaggtaggcctgcatatccggcaacagcgcgcaaggtgtagaataccggatcgcattcgacatgtcctgcatcaattccggcaacgacagttgtacaatttcaccccactctcccggctgacggaccaccagacagaccaaacgcgcgcgttgcataaggcgttgcaaacgcgcggcaggctgatgaatatcgaacggcacgtagcacgcccccacaaaccacgtcgccaacatggttgcaatcacatccctgtgacgtggcaacagcacgccaatacgatcgcccggttgtatgccatgcgctcgaaaacgcatcgcgatgaactgcacacgcgcccagagctcagcgtaggtcagtgtgccgtcatgctgctgtattgccagttgctttgggtgctgcacacagcgctgttcaatgatacgcagcacatcctgcggcccgagccacgggacgttagtggcgttgagcggatcacgccgcggcgttgcggtctccggtgcatgcagagggatcgcccctatcggggtctccagtgatgatgtcaacgataagcagtgctgacgcagcgcctcggcaatctgcttcaccacatcagcatcgtataaccccaaatcgtactcaaaggagacgtcgaacgtggcgtcgttttggaacacctcgactgtcatgtcgtatttgacggtctgattgtgatacgtcacctgctcccaatacgcaccagccaaggtaaaagcgcgtggggtcacgtggttatggtagatatagaggatctggaacaacggtgaatgggaaaggctgcgagggagatccagcatattcaccaagttttcaaacggcagttgctggcgcccctgcgtctctttcacgctggccttcacacgctggagcgcctcgcgccctacctcaaccccattaaaatcggtgtagataaccgcagtgctggcataataaccaatgctactctgcaattccgggcgaatgcgccccgatactggcatgcctatcaccaatcgctgttgctgagcgtaacgcatcagcaccagttggaaggcagtcagcatcagcacgaacggcgttgtttcctgcgtgcgggctacgtgtttcaacgcgaggcttaatgtttcatccagggtgatgctgaaccgggaaccatgtgtagagggttgtgccgggcgcgggtgcagcgatggaaatgtcgacagcagaggcgcgtcttgcaaacgcgcacgccagtaggcaagttcgttcgccagcaaggtatcctggaaccattcgcgctgccagaaggcataatcggcatattgcagcggcggcggaggcagcgacgtttcattaccagcatgcaatcgagcatactgctgctgtaactcatcgaacaatagccgtaacgagataccgtcgatgatgatatggtgcgcgcaaaacaccaaatgacaaccttgatcgggttgaataatctgagttaccccccacagaggaccgcgtgccagatcgaaccgggtgtttatcacctgctgaattaccgcatctagcgctgaagttggggcctgcgctgccagcgtgaccgtatcgagaactaacgaagacgcatcatctatcacctggcaaggccgatcgttacgtactatgatacgggtacgcaagatggcgtggcgtgcttgcacatggcgcaatgcctccgtgagcatcggcatatccaccacgccatgcaaacgatacaccacataaaggttgtagttagtggcggtactgtcgtatttttgcaaaaaccacaaccgctcctgattaaacgacagcgggattgcctgcgccggatccgctttgatgatgggaatgcggctgggcgacacgcctgattgcgccaactgtcgtaatagcttttcctttttttccgccggtaacattcgcgccaatgcggcatgatgtatcgtcatgaccgtcctttccttttcgctgtgttaaatacttttgccaacgtcactcattaatcatgtcgttaactagcacggcaagtgcggaccctccatcatcctgctgctcctgctcgaccaactgcgctaacgcgcgcacgctggcatcctccatcacgtcgaaaaaggaaagagtgacggcgaaccgttcctgtacctgcgccagcaacatgcccagcatcaatgaatgtccgccagcttcgaagaagttgtcgtcaatgcccaagccgtcaattcccagcaatgcttcacaaatcgccactaagccgcgctgcgttttgctctctggagccgcgtaaggcaccgaaaacgccggacgcggctgacggcgcaccgacggttcgctagggatgacacttcccgcgtccgccaccggcgttacggcgctcctctgttcttctggactgtcgacccagtaacggattttgtcaaaggcgtaggtcggtagagagacacggcgcggttgctcacctgcaaacgcagacaaatcgatgttatgccctcgcacccaaagcgctgccacggtatctaagatatgtttgtgctcatcgctgctgcgggcacctgctggcagcgagctgaacgcgagacgatcacctaatgcatgaccgttggtcagctgggtcagggtggcacctggcccgatttccagaaaatcgacatcaaatgtagcttgcgcctcttgcagtgcagcggagaactgcacaggcatcagcatctgttcaatccagtagtccggtgtggtgagagtgtcggcactgacgtgcgcgccggttacggtagagatgatggtgagcgtcggcgggttcagtcgtacattctcaaatgcctgacgtagcgcctgcgccgcatcttgcatcatgctagagtggaaggcatgagaggtatgcaatcgtttgttgatgatgttctgctccgtcagacgctggctgacggcgaggatctccgacgtaggcccggcgataaccgaatagtcaggggcgttaacagcggcaatcgccagcggggcggtaatcagtgcgcgaatctgtgcttcgggcagcgccaccatcaacatggcaccgcttggtgcctgatgcatcagctctgctcgacgcgccaccaagcgcaacgcatcctctaaagagaacacgcctgccaacgtcgctgccacccattcgcccagcgaatgaccaatcattaccgttggcgtgattccccaactgagccacaattgggctaaggcatactcgacgctgaacagcagcggttgtgtgaggcaggtttgcgcaaggcgttcgccttgggctaacgagacttctgctctgaacaactcatggcggatatccagttggtattcacgctcgagtaacgtcgcgcaacggtcgaaggcatcggcgtaggccggccaaacctgatagagctgatggcccatgcgctgatattggctaccctgcccggaaaacaacagccccagcccgagctgtgtctgcgctacaccacgagcaaacggcgctgtcgcggcctgctgcaacagcgtcccggcagcatgtagatctctggttacgagcgcggcgcgatgtgcgaaggctttacgtccctgtgagagtgtccacgccagatcccgcctatccggcagcgattcatgttgcagaaaatcggcaaaacgcgccagccccgaggataaggcactgtcggtcttggcagaaaacggcaaaatactgtaggcaggtacaggcgctcgcgcttgcaagtcaacggctggcgcttgttccagcacaacatgggcattggtgccgcccatgccaagcgaggtgacgcccgcgcgacggatgccgctttccggttgccacggttgacaggtagtgttgatgtaaaacggactattggtcagatcgatctgtgcattgggccgttcaaagtgcaatgttgcgggaattattccctgctgcactgccagcgcggtttttatcaaccctgcgacgcccgctgccgtatccaaatggccgatattggtttttaccgaccccagcgcacagtactgcttttgtgacgcgcccgcaaaggcttggcttagcgcagaaaactcaaccggatcgcccaaacgcgtaccggtaccgtgggcttccacataagtgatatcctgcggtgtcaaacctgccaaccgctgtgcctgagcaatggcgcgcgcttgggcatccacgctcggcgcggtataactgatcttctccgaaccgtcgttgttgacggcaaatcctttgatgaccgcatagatgttatcgccatcacgcagcgcttcatcaacacgctttaacaccaccagccccgcgccggtgccgggcacaaatccgctgctgttatcggaaaacgcccgacagtggccatcggcggcggtgatcccaccttcctgcgacaagtagccggtttttgctggtggccccagcgttactccgccagcaatcgccatgtcacactgccaagtcaacagactttggcatgccacgcacaccgccaccaaggatgtcgatgaggaagtctgcaccgtgatcgccgggccgcgcaggttgaggtgataggcgatggtagtagtgatactgtctttgtcgttaccaatggccgcctgcaaactgccagaagagaaaacgcgtttaaagtgcggcatcaagttcagcatcaaataggaatccatgcttttgccagcaaaaatacccacatcccccggataatcggcagccacatagcccgcatcttcgaaggctgcccacgcggtttccaacaggacacggtgctgaggatccatcagctccgcctctcggggtgcgataccgaagaaagcagcatcaaatttatcgatgtcagctacctcccctttggccttgacgtaatctgggtgctgaacaaattcaggactgattcccatcgccagcagttcctcatcgctgtaaaaggaaatgcactctcggcttgccagaagattttcccaaaacgcctgtaccgtatcggcttgagggaaacgccccgccatcccaatgatagctataccaaaatcattctctgccatgttgctttccccctatattcaggtttatcacgcgtttcattcagtggaatcagtgatgactgtcggttgtggctgcccagcgcgtgtgaccaaaggccaaacgctgcttcgccgcacgcagttgtgtctgatctcctgtggtcccttgcgctgcgtccggggccagcagaaattccgccaagcgtttgatggtagtgaagcgcagcaggtcaaccaacgccacgtgctgaccgcactgctgcccgatgtattgctgcatctgtactagcagaagtgagtgtccaccgagatcgaagaaatttgtggtggtgccgacacgctccaggccaagcaactgctgccagatctccgccagacgctgttccagttcggttgccggagggacatactcgcccggcccttccaactgccgcagatcgaccagcggcaggcactggggatcgattttgccgtttacacctagcggcatggcgctcagcggcacgtagagcaacggcagcatatgcaacggaagccgcaggctgagccatacgcgcaattgctgagcatccagcgcaacgccgttgacgctgcaatagaaggccactagtagcggcgttgccgccgcattgcgtcgcacatcgacccacgcatcagcaatatccggatgctgtttcagtaggctttcgatgtcgcccagttcaactcggtatccacggatctgcacttggcgatcttgtctgccgagatagaacaacatcccgtcggttgcccaacgagcacgatcgccagttttcagcacccgaacgccagggtattccggcaactcgacaaagcgctcgggatcctgtcgtgcatcaaggtagccgggcgaaatgcccagaccagagaaacagagttctccacaggcacctggcggtaccaaacgattatatgcatccaccacataagcttgggtgttctgaatcgggcggccaatgggcaatgctcccgtttcttgctccctacgctttgcgacaggaaagtaggtcgagcagataccgctttcggtcaggccataaccgttaaccactgccatgtgcggcagaagcggcgctatctgctcatactctaacgcttcaccaccgcacagaaacaagcgcagcgatcccatcgactgagccagcacagagaggctggcagaaagcgatggggtggtgctcaggatagtcacccgctgagatgccagcagcgcaatgagcgcatcactatccaaactctgcgctttttgcgccaatactaaggtaccgccagcggcgagcagcggcagtacctccccgacaaagctagcagacgcgactgaggtaatgggtagcaaaacatcctgatgcgtcacttgatagctggatataaaggatgcggttaagttgaccagattacgttggctgagtcggacgcctttgggctgcccggtagtaccggaggtaaagatcaccaccgcatcgcaatctaaagcatctggcgcaacactaactggcaggttcggtatttctgtcagcaggctacgccagtcaggcactagcacccaaggtatcgtcagcccatgaggggattccagcggttgcgccaccagcagcatgcacggcgttgcctgcgccaagatcagggcattgcgggccgctggcgcgttaccatccagcggcacatagctcgcccccaaagagaggatcgccaattgtgcgataatcaattcgaaacaaaaaggcagttgcagtgcgacagattctccgcgttttacgccttgcgcacgcagccaagtacacatctgcatcgtggcctgttgcaattcgccataggtcatggcgtcgtcagcgtggcgcaaagccacctgtgtagggcgctgctggcagtgcggtaacactagcgccagcaggttatctacgggcggcagagcaacttcagtggcgttgtgccgcgccagccaagcgtgctctcgaggggtgaaacgaatcaaatcgcggactaactgcgtgggttggctgctggcctcatctagcagttctctccactgcgccaccaggtgctgaatacgatccgcactgtataacccagcgtcgtattcgaaagtgccggtgatgcgcccatcgatatgctgcatacttagcgaaatatccacctgagatgcactggtatccaacaataatggtgtaacgttgacaccgtttagtgtcgggctcgccagaggcatattgtcgagttggaacatgcactgatatattgggaaatgtccggcgctgcgatccacattcactgcgcgcactatgtcggtaaattcgagacgctggtgcctgaaagcggcaaacagaatacctctgatcgtctgtactaactcggaaaacgatgccgcttcgtcaagaggtaagcgcagcggtagtacgttgaccagcggcgcgatcatatgctcctgttctttcgtcagccgcgcagcaatcggcataccgacgatgtattcctgttgacgcgcattacgatgcagcaggaggacgaaggcggtcagcagatagttatacaacgacacgcgctgcgcacgcgccgccgccaacactcgctcgcatgtgttggcagacaatgcgaaggcaacaaacgcgccttggtaacgtgccaccttctgacgcggttgatcggtggggatatcaagaatcggcaacgtccccgccagggtattttgccagtaacgcatcgcgtcctgataggcgtcactctgacgccactcttcttggtactccatgtagtcggcatactccaacaacggttctggcgtcagcgattcaccgttatatgcggcctgcaattcgcgtaacaaaacgcctttcgaccagccatcactgatgatgtggtgcagatgaatcaacaatacgctacgatcgtcatcgagcgtcaacagttcaaaccggcacagcggtgtgcctgacgttaagggcatggggtgtgccgcacgctggttgatcatcgcctgtagcgcgttatcatcactcaccgaggggagtggcactatggtcagcaacgcctgcgacgatacgcactgaggcaccgccaatactggttgtccattgtgggtttccgccatagcacgtaacagagtatgccgactcatcaattgacgaatcgcgccgtccatccgcgtgcgatccagttctccttcaagcagcaaggcggtggggttattgtatagtgcagtatgcggcgccaattgttgcataaaccacatcgacgattgagccgatgacaacggtaggtagcgcacggcgggagtttcacgtaaatcgacgcgactggctgagtacgcccgcgccaagtcgagcaacgttttacgacagcacttgccattgtcggagagtggtaactctgacattgccaacaaacggttcggcagcatgtaggcaggcaagtttttggacagtgcgtccattaaggccgccaaattgagcggcacgctactgacgacaaaagcgtaaatcaactgattgtcgggatcatcctgatccgccaccacgactgcctgctgtacccccgggaaacgcatcgcatgggcttcgatttctcccaattcaacgcgcaaccctctaattttaatctgaaaatcattacggccaatgtaatgaatttgttggctttccccgtcgcgccacaccagatctccagttttatacagccgctccggtttccctaaatggcgcaaagttggatgtatagtaaaacagcgatcagttaacgccacgttgttgagatagccacgtgccagcccgataccagcgagatacagttcgccctcttcgccgtctgctaccggattaccatggtcatccagcacatagagtcggcaaccgtcaatcgcttgaccgatagggatatcgtcgtagtcgtacccgcgcaggcagcggtgatgactgacatcgattgctgcttcggtcgggccatagagatttataagatcaccctgcgccaccgattgataaaagcgagccacactgtggaccgtgagtttctcaccgctggaaaacactaatcgcaatgaggcggtcaaacgaggatcctgtttcatctccagatactcgacaaacaggttcagcatcgaagggacaaagtgcacaaccgacacgcggtgacgctgaatcagtcgagccaaggttcgcggatcgctctccagtccggacggtaacagcactacagatgcgccgtacatcgcccaccagaacatctcccagacagagacgtcaaaggtgtacaccgtcttctgaaacagcacgtcctgagaactgataggataagcgttctgcatccagacaattcggtttagcagcgctgcatgttccgtcgccacccctttagggacaccggtggaaccggaggtgtaaataatatacgccagttgccgcgcatgtggtcggtaacgcagatccgtcgttggcatggcactgaccgccgcgctgtcgatttcgacgcgaggaatcggccagcgatcaccatcgtcagtaccgatcagacaaacagcgccgctgttgctcagtatattttcaatgcggctgcgcggtgcattgtacgccagcggtaaataggcaccaccagcttttacaatagcgaaaatggcaatcagcattgccatgccgcgcggcaggcggatagctaccacacgatcctcgccgatccccagcccacgcagataatgcgccagttggttagagcgtgcattaagatcgtgatagctcagcgccgcgtcccccatcaatacagcggctttttccccatattctccggcgatacgatacaaatagtcgactatcgtttggtcgtcggtaggcaactgtctcataatcccttgctgttccataactctggccttcaaagcgagataagtacgtaaaatggcgtgacgggttacgcctgtccgccgttgtcggaagccaaccgcgcgtggcaggcgtcgatttctgcctgactactgcctttgagttgaaatccctgttcaagaagctcatgcaaaaaagcaatgtcctcttcgctggatgtgccgcgctgctcaatctgctggatgcgctcaaaaaaacgactgagcaattctttcaattgcgcactggcagccacatcggcggcgcggtgatggcgtgtggctgtcagggcgttagtgagcagcgtgatgcgttggcggcgcacggcttccggatcggtcttcaccgccatgttatcccccagcaccaatgctagttgcgcacgatcatgacgattgtcaaatgcgtaaactggtgctggatagcgattctccagcagcaggtttttcagcacactttgcggaccgatctctatcgcgatcggtgacaagtgtcctgtcaggtaggtgagagagcgctgccactgcactggctgagagagctgttgttctagccactggactggcgtgaccgtatcgggatagggttgagcgttgacattggagatcactgggcagcacggacgtcgccattcgcagcgatccagcgccttgcgcaattgctgtccgcaaggtttcaatagtgggctgtggtaaggaacaccaccaatcagcggcactacttcgacttggcgatcatgatccagcaggtattgctcggcggcgataatggccgagttttgtccggataacataaactgttgcggcgaattgaagcaggcaataccgacctgctgtcgggtttcacgctccgccacctcgcacgccgctgccaccagtgcctgattcccttgcttgatgatagtggtactcgcgtccatttcgcgggcgatctcactggctaaacggctacgcatcgccaccagcgccagtgcttgggaaaagctcagcgcaccactacaggtcagcgcagcatattcgcccaaactatgacccaacatataacgtaggttgacatggacaccggtttgcgccaaaaactgctgccacgcgacaaagtgggccacgctggtggtatagatagccagcgccattgccgtcggctcagcaagttgtaccaaagtacccgacaggcacagcgctgccatgtcccgttccgtgatctggctagcttcatcaaacagagtacgcacctgcggataacgctcatacagccaccgtgccatgcctacatattgcgaaccggagccagggaacatcagtgcgacatccttcgtcatgcttcactccccatcatgtaattcatcgcaatttggatttcatgaatttgcgatgtcccttcgatgatttccatgattttggcgtcgcggtagtaacgttcgacggcataatcggcatggcaaccattcgcaccgagcagttgcaccgccttcccggccacgtccaccgcagctttggaagcgacatacttcgccatcaggatttggtttatcatggccgggtgcagcgtttcgcggtattccgccgcgctgaagcacattagttgcgcactgcgcgtttgggtcagcattgtggcaaacaagtgctgaacaatgccatgagaaaataaccgccgcttgaactgtttacgctggcggatgtagcgcgctgccacatccacagcggcccgacataatcctaggctgccacaagcggtggtgaaccgcccttcattgagcgcaaaattcaccgccagcggtaccccaggggtgagcggaccgagcaatgcatcctccttcaggcggcagtcattaaaatgcagctctgccaacatattgccgcgtaaccccaacatgtcgttgagtggagtgatagtaaagccgtcggtattgcgatcgataagcactgtcgctaattgattaccacagtggattaaaacaataaaaaaatcagcaatctgccctagcgtgatccatttctttttcccgttcagccgccaaccgtcgccatcctgctgtaattctgtttccacgttcactaagtcactgccgatattcggctctgtgagggcaatcgcgccgatcaattcccccgttgccagctttggcaaataatgggctttttgcgctgcgctgcccacgcgttgcagcagcgtgctgaccatgccagtcactgttatgagattttctaacgaaccgtgaaccccagccatcacttcatgcaaagcgcacagttgataagaatcgtaacctcgtccgccatatttttgggggattgacgcacctaagtacccggcctgcgccacgcaagaaataatgtctggcacaataaactgctgacgttcaatattctgtgcagccagggcgagatgttgtttggcaaacaggactgcctcttgctgagccagctcataattttcagtgcacatagtttactccaggcctgtttgtcgctgaatgagctccactattttattgacggtagcaatctgttctgttttcaactcactcacttccagctcaacctgaaaatttttttctataaacagtatgatttgcacagtaaataacgaatggacaagcccgagagaaaaaatatcgtcatcatcgttcaacgtatgcccacgtaatgagcgtgaaagaaattcccgaatggcggctttcatatcttgctttttcatattcatatccctatctggttaacccagaatcactgctcggcgtacgtctgttgatagcgataaaacccctgccctgatttcacgcccaaataccctgcatcgaccattttctttaataaaaagctggggcgatacttatcatcattaaaactttcatatagcacctgcaacgattgcaaaatcgtatccaagccaatcaaatcggcagtttgtagtggccccatcttgtgcccgaagcaggttttaaacaacgtatcgatatcctcagcacgggcgatctgctcctgcaccataaatatggcttcgttaacaaaaatcatcatggcacgattagtgacaaagcccggagaatcattgaccacgatgccggttttattcaactgagcaaataagtggtgaaatatgttcagtgtacgctctgcagtatgtacaccacggattaattcgacggtgtgcatcagcggtaccgggttcataaaatggacgccgactacattctccggatgtcgcattaattttgacaacgcagtgatagatatggcggacgtattaacaccaaacactgtcgacgcgccgcagatcgtattcatccgtgtgtatagtgcattttttttctctatatcctcagtaatattctcaatcaccaaatcacattctacaatgtcgtccaactcagttgtgaaacggatattttccattatctccgctgtgctatgcgtcttttttttatgctgcgggtgaaaattatataagcgtaagttcgcttcgatcatctgtcggcatttatccaactgagattgagaaatatccacaacgttagttgatatgccgtattgcgccatgttatgagcgacgccagttcccattactcctgcacctattaccgccacgttcatcattgagctcctttactgacaggctatttcgaggttgtcttcgccccccagttgcgccgcgatatgcgcgtagatattgcgcggattggggttttccatcagggtcaaaagatcgatatgtacgttgaaatcgcgttctaaacgggaggtcaattgcgtcaccagcagcgaatgcccgcctaattcaaaaaagtcgtcgtccaccccgaccggcgatatttccagcaacagttccatcagacctgtgatatactgcataccccgcgagtgtgcggctacgaaaggtacgcttaacacgggacgtgcctgataagggtggtgcgtttcgggtcctgcttcgggttgggtctccacactacccattacccgtccaggcaatgggtagtggttgtgtgcgaagggatatgctgatgcgctcccgcgttgcggcagcggagtgccgtaccacacggcccaatccacattgatacctgcacaccacagttgcgccacgtagcgcaatacatcaacgtcttctcttatttccggcggcagcctaacccagttgatactgtgaacgccctcccccagttctcgggtatctgccaacagcgcttcactccaaaaccctctgtcgttacgctgtgcatcggtgatgggatttccttgccaagccagcacgtagccggggataggttcatggcgctcaggaagccagagatgaagcgccttttgctccatttcccacagcaaatgcaacacgtcttgcgtcgcaatcatgccactggctgcagcggcaggcaaaaggcctgttccagcacccgacagcagtgttaatgtcggtagcaggttcatccaggtttttagcgcggcgatagtctggcagcctctgattagcaggctgctgttcgcttgtgccgcccacgtttcagcgtggcaataagcgggtggaatattcatgccgtcgagtaatgccgtcagagcagtcgcttcgcgttgataatgtgccgaatgcgccagccactgtgcgtaagtacaatcgttcgtagtacgtagatctggacagtgtaggccccaaggagcgtcgggcattaggttatccagcgatgccagcatcgcttgcgtaccatcgttttccacttgtatcactcggcggcaatcaaacacggggcgcgccacttgttgtgtgtaggctagcgttgacgcatcaagggtagccagcaacggggtaagctgttgcgtcagctcatccaactgctcgaaagacggcgcggagagagggataaacaccggtgctcgcacttggtcatggtcatcgcgcaccgcaggattcagcccttccaaaatcatatgcacattagtaccgccaatgccaaaagaactgacgccagcgcggggcggcatccgcgatgcgggccactcctgcggctgtatcgggatataaaacggtgaatgcgccagatccagcttcgagttaggcatttgatagttggcgagcggcggaatggtccggtgatgaagtaccagcgccgtcttgattaacccagccacgcccgccgccgcgtgggtgtggccaatattcgcctttacagcccctagtgcacagtattggcggtgtgaagtatcgaacgcctccgtcaacgcagcgaactcgataggatcgccaatacgggtgccggtaccgtgggtttcaacgtagccgatgctttctgggcttacttctgccagatgacaggccgcacaaatgaccgccttctgtccctcatgaccaggcgcgacaaaaccgattttttgtttaccgtcattgttgaccgcgctaccccggatcaccgcatagatgcgatcgcccgctgccagagcatcttccaaacgccgaagcacaaccacacccgcgccatcgccaaacagggtgccagaagcctgactgtcaaaaggacggcagtggccatcggtggagtggatcatgccctgttgacagaagtagcctgacttctgcggtaaatcgatagtaattccacccgccaacgccagatcacattcgccaaacaacaagctgcggcaagcgatatgcgttgcactcagagaagtcgaacaactggtgtagagactatacaccggaccgttgagattgagactgtaggcaatgagatgtgcgagcagatccttatgaccatagatgccagactcaaaacgattcagcgcatcgccgccaatctgtgacagcgaacgccgtagccaatccacatcttctgacgcccccacgaataccccggtgatcagatcgctggtacgttgggcatagcctgcatcttccagcgcatggtaggcaacttcatgtaatacgcgggatttcggatccagagtctgcgcctctttgtgactgtaaccgaaaaatgcagcatcaaagtcgcatatgccctcgatatagggcttggcccgtacataggccgggttgtccagagtactctgttcgacgccttcggccagcaactcctcctcgctaaagaaggtgacgcactctttaccctgaacgatgttatgccagaattcgtgtaacgtccgggactgcgggaaacggaccgccataccaataatggcgatttccatgccgttcatttcgcttgcgtattccataaacttcattacctttcttcagggcgaggaggcgcccggattaatgcaaagacgtgtgactgcgcgcagtatttttcgcaatttgcaaagcacgttttgctatctgattcgcgcgcgtattcgtctgtactgcaggctgtggtgatggcgcatttgactcgccctccgggggctggcaaaacgtcgccagctggcgcacggtggcgtggttgtacagcgacaccacgctcacttgcggatagtgacgcgccatttgcccactcagttgcaccatatcgagtgaggttgcccctaattcggcatagttgtcgtcaatgcctactctatccagacccagatactcttccaggatttggcagagcacgcgttccacttcacgtgtcgcggggctgtaaggcacgccaatttccggacggggccgctttttcactgtctgctgagtaatcgtatcgttagcggcagacggtacaccgcgatccacccggttgccccgcgctaatctatcgatcgcccgaggtgagagcagcagttgcgcccacggactgcgagtgttcagtatcggccacaattggcgcatcacctcggcattgctcatgctgagcgcatagccgccgaggcgcctttctgctatcatggcgttcagccggtccatgcctgccgcagtgcgatgcgttaccaccaccttgccaatatgctgcggcgtggtcagggtggcgaaggcgcgtgcaacctcgggcaatggtacggatttgcatggaaggagcggtagcgtgttatcatctatccaagcgacaatctgttgcaggtagcgactaaacgcaccatgcgccgcgtgaaaattaatcggaataaaggtgccgccttgggcgaagaaacgcatcggtagcgctttgtcttccacaatgtccttgctgcccagctcaagaaaacggcccagcggtgccagcagcgcgaggctagcgtcaagcagacggcctgtgagggagttaaggatcacatccatcccctgtccgtccgatgcggtcagcagagtggcagcgaactgttcgtcgtgtgaatcagctacggcatgtacgcctagcgaaagcaagtaatcgcgtttctgctcgctacctgctgtggcgaaaatctgtgctccgcagcgtttggcaatatgtagcgcagccaagccaacgccccccgccgcactgtggatcaatactcgttctccgggttgcaaattagcgcgcaccaccagtgcgtaataggcggtgaggtatgcgataggcagcgcagccgcctgttcgatgcgacaatgggctggttttctcactacgcaatcgctttctacccgtgcgtactggacaaaaccaccgtttagcaccgccataacatcctctcccggggcaaattcagtgacatttttacccacgcgagtaatgcgtccggcgcactccagtcccaattgcagcggagcctcacccggctgctgccggagcaatcccgtggtgaacagcacatccttaaagttcagtccggtggccagtacctcaatctctacttgtgaatcccccagcgctaagcgcggcgtagggcacaacgctagctttcctgccccctccccctcagcggccagccgcagttggtagttatcggcactgggcacgcgcagtcgcgtgtcgtcatcgacatcttgtatgtggagctgtaccttgcgcttcaccattgccgcacagcgggcaaccatctcgcctgccatgtcgtagagcgtgaaagcgtagctgtcaccctcctcatcgtgccgattgacagtcagcgccacatgtaaggtgttcggcaacgggcggtacaggcgtaaatcctgataaaggaaaggtaccgaatcagtatgaaaaccaggcagttgttcgacaacactgctggcgatgtccaacagcgcagggtgcagtgcgatcgtatcattagcggcaacggtgggcagggccagcgttgcgaaaacctgagtctgggcggtattgccatacagttgttgtacgctgtgccagcgcggcccatagtggaagtgcgtgctcgataattcctttgttggaggagtgatagtgtgcatctcgcgcatcagccccgtgagatcgcacacaacattatcgtctaccatcagacgcgtcgccctgcctctggcatgggttgttaacgtgccactaaagcgctccgtcattgatttcacctcgacactaactccttgcccgttaggtgaaatgtcaacaaaaacgtcaacactgcagttgtccatcacagtcaacggtgccaaaaagaccaattcatcaatgcagatttggtcttgcacaaagtaatggcgcagagcttcatacgccagcgccagatagccggttcccggcagcgtggcgataccggatatccggtgctcatccagcagccaatcggactcgggggataatcgcgcgtagtagctggtgtcagccccttgttgtttataagcctgtagcaacgttcccgtcatcaatgggcgcagtccacgcaagacatcgtattcactgccgtttatagcatccaacaacatgccctgctcacgcaatgcatccaacccgatactgagcgcattcaccttgtagcgggtacgcagttgctgtgccagtgcatccaaataggcgctggcggtagcatagcctgtctggccaatctccgcattcacggcagccaacgagttacagaacagcagtagcagacgctcatccagcagattccgttgcgctaacgcatgcagcacattagcagtaccccgttctttcaccgttagcgtgtcgcgtagcgcagattcgctcaattgatgcagtgtcaatgtggtggtagcgtcggcagcaaaaatcacgccatccaaccgtccatagcgttcgagcagagttgccagacaagctctaaccgcctccgcctgcgtcacgtcgcagtggataacgtctaatgcgtcctgctgcaccgcttcatggtgataacctgtgcggctgctcagtaccacacggactccctcacgctgagcaagcgcttcgccgatcatgcggccaatccccttttcaccgccgataatccacagtacgttgcccggtatacaccctgtttgagggggtaagtgcgccaacagccgtgtcgggataaagcgtcgcaggtaaagcatcccctgcctgagcgccattaccgtttcttgtttcggggccagacgctgggttagcaagttcagattctcatcactgctctgcgcatcgatatcgatcaatcgtacttcggtcgggtgcagctcttgggcaaacacgtttactgcgcccgacaacgctgccagcgtcggttcgggattatcctcttcctgtacgcgaaacgcaccatgggtcaatactgttaaggacgccagcggcgtggtgctgtgcatacaccagcgagcaacacgataaagtcccgagagcgactgtgtcaacgatgatcctgcctccgcaccgggagcatacaagcaatgtaactgtcggtaggttttgtgtgctaaaagtgcgcagatgtcgtggaaatgcgtcagaatacggtcattatcccacacgtcgtcctctgacgatatcggcagcggcattgtgatgctgtcgacaccactactcatcagcgtctgctgtaacttgtcgccgtcagcactaataatgatgatcaattcgcccggcgcatagaacgcctcccgcaaggatgtgtcgtgcatccgccacagcacacgctggagccactcatcttgcggacggcgcagaggatttggatactggcgataaccggaaagtgcagcaccatagcgatagtaataagtctgttcgaaggggtaatccggcaatggaatgtgcttgccgagtgccgtctggttaaagcgtctccaatcaatattctcccccctgacccacagcgccgccagcgtacgatgcaacatgtgctcatcatcgatcgccgcgttggctttgcgtagcgtcaacagggtcggctgatcgctgtattggttatgtccttgaataaaggtagagagcgtattacccggcccacattcgataaacagcgtgggttgtaccaacagttgcgccgcaccttcgctaaacagcaccgcgttgcgcacttgctgcacccagtaatccggcgaggtagcttgctcctcagtaatccatgtaccgcttacattagatataaagcgcttgtgcggcgcgtgcatcgggatttgccccagcaactgtgcaaaatcgtgcagcatcggcgtcatcatggccgagtggaatgcgtgagaggttttcaggcgcctgtgctgtatcccgccctcgactaagcgtgtgctcaaacgggaaatggccgcctgctcgcccgcgactacgcaaaaatgcgcgctattattagctgccagttcaataccccgttctgcagctagccatggggtcaactgttcgcgactaaggtagaccgccatcatgctaccgggacgcatggactgcatcaaacgtccgcgcgcctcaatgacgtgcagcgcatcctcaagagtaaatacgccagcaatacaggccgcaacatactcgcccagactgtgcccgatcatactgtccggcgtaatccccagatcaatcaaggtgcgcgctaggctgtattcgacacagaacaacgccggttgtgtgaactgcgtttgatcaatatcccgcgtatcctcatcgtcaaacaacaacgccttgagatcgaccgtcgaatagcgttggaatgcagcaaagcagcgatccatgtgctggcgaaacatgggttgatgagcatagagcgcgctggccatgccgtgatattggctaccttgaccaggaaacatgaagcagatctccgctgtcgtgcgctgaccattgaagatttccgcttgcaatatcgtggcacaggagagatcgattttcgacccacgactcaccaaataagcccgccgatggtcaaaggctgtgcgtccagtttgcaatgtataagccacatccggcaggcgcacccctactccatgcttgacatattccagtgtggaggccacgcgcaactctaacgcagcgggtgttttagcggagaacaacaacagatagctgtcgcgtacccccgtcgctgaagggtcgtcctcatgttgatgtgcttctagtgcgatgctggcattggtgccgccgatgccgaaggagctcaccagtgcacgacgaggacgcgtcgacggccacggttggacttgctggttaacgtacaatgcagaacgcgatagatctatagcaggattgagttggcgaaagtgcgctgttggtggcaacacttgatgatgcagggcgagcgttgttttgatgacgcccgccactcccgcagcggagttgaggtggccaatattacttttcagcgctgaaaccacacaaaacggaacaggtgttgggccaaacacctcattaagcgcacgtaactcaataggatcacccagcaccgtaccggtgccgtgcgcttccaccaatccgatactgtcgctatcaaaaccggcacggcgcaaactggtgcggattaccgttgattgcccgatcacactcggcgcggtatagccgattttgttattgccatcattattgaccgccgaacctttgatcacaccatagatgcagtcccgatccgccagcgcgtcgtccagacgttttagcagcagcattcctaagccatcaccggtgactgtgccagaggcttggctatcgaaaggacgacagacaccatctcgcgcattgatcatgccttcatgatattcatagccccggtacgcaggcatctcgatagaaacgccgcccgccaatgccgcatcgcaatcccggttacgtagtgcgatgcaggcctggtggatagccactgccgaagtggagcaggcggtgtcaagcgtcacggcagggccggtgaggttaagcgcatgggcaatcaatgctgtgacggaatggatattcaggatactggccttgtacagggcggtagagtcggtagtgtcttgcattaccgcattaagccagtggggggatgtcagcagtccggcataaatgccaatcgcaccagtaaaggtggcaggatcgcacccagcgtgttccagagtttgccagcagcactgatgcaataagcgaatttgcggatccatacattccgcctcgttgggagtataaccaaagaaatccgcatcaaaccattcgtgatcatcaacaatccctttggtttttatataattcgcttgtttaagcgtgtcaggtgtcacaccatgcgcgcgcaactcttcatcactgaacagtgttaatcccgattcccctcctacaaccagcgtccacaacgctgcaatattcgccgcaccggggaaacgtcccgccataccgacaatcgccaccggcatgtcgctgtagacaacagcacgcgttggaattgcatcctccggcgatacggcagtatcgagaaaatgtgctaacgccgtgagcgttgggtacttaaagagatcggtaatatcaatctccaagccaagttgccgcttaatatcccctttaaccctgatggtatccaatgaggtgccaccgagggcgaaaaaggaggcattgctatcaatgtcttgtctatcaagtacgcgttgccagatagcatgcagcgcatgttccatgtcactatgcacctctgatatcgtggtggacacggcgttgcactgagttgcgggcaggagataccgcaactgcgccaagtcggccttgccactatggctttttgcaatctccgtcaccaccaccaaggattccggaatagcgaatggcggcaatctgtcagccaattgccctcgaacttccacctcatcatagctatcattgacgcagaccactgccgcaatatgcagcgtttcacgtacgcggtaaggaaccactaccgcctcgataatgccggagcactccagcaggcgctgctcgatctctccggtttcaattcgttgtccattgatcttaatttgaccgtctttacgcccaaaacagtcaacacagccatcatccagcaaccgggcataatcgccagttttgtacatcataccgccgggaataaaaggatcagggacaaaaaccgtcgcacttagcgccgggttgttctgatagccgatggcgacccccactccacccgccactagttcaccggtggcaccgataggcaacaaatgcccatggagatcggtaatgtagagcgaggtgcccggtaccgcgtatcctatcgggactcgggcgggttgcaacccgttgaaacgatatgcggtggtaaaaatagtgttttccgtcggcccataaccgtttgtcaccaccagatgcgggtatttttgcatcacgtcgttgacatgccacgcagatactgcttcgccgcccaccgtaatgtgttgtaacataccgaagaaatcggcaccttctgccacataggagttaaacaaggatgaggtaaaccaggcgcgcgccacctgttcatcagcgatcgtgcggcgaatgtgattgatatcaagtaatgcctgtttgctgagtaatactagtttgccgtggttgagcaaggtagaccacatctcaaacaccgaaacatcaaactcaaatgggcaggtcagcagcgttgtctcaccgctctccaccttcagcgggctgtcgccttgtatcaggcgcaataaaccgcggtgcgccaccgcgataccttttggcttacccgtcgaccccgatgaataaatcacataagcgcgagaatctggtgtgataaccggaaataccaccgagggcgcgacgggaaatgcacagaggtcactctgcgcaacgtttaatgcatctagcggtttgccatgtaccagcaacagcgccaagccgctgtcatcaataatttcctgcatcctacccactgggtagtcggggctgatgggcacataagcagccccgatcaacatgatggcgatgatggcaaccacggtgtttacccggcgttcgctaattatgcctacagtatcgccaaccataacaccctgctgtaccaaataagccgcgagctgctcagcttgtgctgccaactccgaataggtcaacgcgcacaattcatcaaccactgcgacctgtgctggcgaagtcgcagcaacttgatgaaattgttcgatgacgttggattgactatcccaatcccggcatgccatgcgttccagatagggttgaagtacctgcgcctgctggcatggggacaagtttaccaacgcagcaatggggcgctgcggattgtccaccagttgttcaagcagataactcaggtgcatcagcaacgcttgcgccatgttgttggtcaggtagttaagggcatatgcaatactgaaacggaatcccttctgttgagtgatggtcaaggtcagcggatagtgcgtttgttcatgtacactgagatggcgaattgccacgggcgacgcgcatgacaataatgtcatatcaacgggataattctccaacaccactaaggtattaaaaagatccccagcatgaccttctttatgtaccaaccgttgtatgctggctaaggcatcatgttcattgctgtagtgagctattagtgtttggtgcatacgttgtaagtgttgcaacagtgtcgccccatcatcacgcagacgcagcggcaacgtgttaataaatagccctagtgtttcttctataccatcaattggtatatttcgccctgatattgtcgcgccgaataacacatcgtcagcatagcaccaacgttgtagcaggatgccccaggccacatagaagattactgcgggggtgatacgataatcgctgcatagcgtctgtattttctgacacacatccggagacaaattgatctccacatgatttgtttgattaacgtaagaattgttctcggcttcagtatctgtgtgatattgtgacagcggcacgatacaagttggtgttccctcccgaagatatgcagcccaatagtcgtgctgaaaggtgtgacgtcgggccgacagtgtgtctacaaggggtttcagagatgaggggataatggcgctatcatccctcacaccactgaccacagccgctccatagagttggagcaactgtttaatgaaaagggataagctccagccatccatcacaatatgatggtatgatagtataaaagcactttctttcgttgactgaataaggtaggcccggactgggatcgttttcaaggaaaatgggtattttaaatcagcctgtagcagttgaggaattatagcatcaataccgtcatcctgcgggacaggaatgataatgtcatcattagctagtagaaaacgtatttcctcttgctcacagtctaacacatatatatccggcaacacatcggtcttcaccacctgacaagggcgctcatcaatctcccagttataatcagtgcgaaaacactcatgctttcgaaataacgtttccagcgcccacttgaagtgggcgctatctacatgctgagaaaaaatgcatgtaaaatgctcatggtagttactccttttcttatcctttaaggaatggaataaaaacccctgttgacttggtgttagcggtaactgcttacgcgtgtccatcttattacatggaaaatctccagaggtattatccataaccatcaccttattatcggatttatagattatttaacatgattattctaaatggcacacctatccgcaagtatagttttttattgcgtattcatataatcatattgcattttatcacttacaggaatacccccaaaaaatccttatattctgattacatgtttttcttcaatgaattagattctgtctgtaagcaaaaacatgtaagtcatgcagtacatacatgatgtagcgggtatgaattgatacagccaccacatagaaaataatgcgtaattcccatttacataaaaaccgttgtatcgtaaattcctcttaaatactgccaaaacaacagatacacagatacacagatacacagatacacagatacacagatacacagatacacagatacacagatacacagatacacagatacacagatacacagataccattcaggatggggggaaactaaatgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattgaatcgccacggataatctagacacttctgagccgtcgataatattgattttcatattccgtcggtggtgtaagtatcccgcataatcgtgccattcacatttagagatcatccggcataatcaatctgccaacgaaggagagcgcttaaaaccagcctttaagcgtgagctggttactcatctgataacgacgttcgaactcagtatccgtcaggcctgccggagtctgaacctgagctggtctgtcgatttttagagcagtgtccatattacgagggtaggatcagtcgtttctttcgcggtaactttatatgatcgctgtgtaccagcatcgagagaagaaattcaggatgtattcaacactgagttcacaagctctgtagctattaagtcagtattatttacgtttacgatacatgttattatcgcaggatctttatcttggtagtgatactgcgagtggatacacccccactcagtatcttctataactatggcttttggttcttcaggcatcataccttccataacacgttcttgatggatacgtaacttgtagtacttctctggagatgaagaaatttcaacgagtacagattgtagatgtacgaagcctagaaatttaaaacactcggattttgtagaggattttaatgataaagtccagataacaaacacgttattggaaccatcaccataatttttagtgtcaatcttatctaccagctcctcgttgattaacatagactgatttagcaacttccgcttcacgccctgagcggactgttatcgctctttagacacagttccactaggggagaggatcagcgcttcccacgtagggacactatagtaactatcaccacatgcagtagggaagctcaaaccaaatttatgtagccagctcctattggtggtcattctggtggtcttgacaggaagataactctggtttagcttacttattagccacttactggcaaaggcgatcccagtcagaggagccaaattcaaaaaagcctgctttcgagcaggctttttactttctaattaccaacgctcttaaaacatctgtcttgaaccagaactaatttgcacaggcattcccgatcgatgttgcaacgcagcatttgcgcgatttacatcaacttcttgcccgttgataaacgcccgcaaagatggggttaccggcaatggcacttttcggtcagactcatattctgcacgattgcgcgacagcggctcatgaacttccagccactttgaaccatccggttccgttgtgtatttcactggctgatcaataatttgtacacgagtgcctacaggaacattatcaaacagatatttgatatcgtcattacgcagacgaatacagccctgacttacacggag

SEQ ID NO: 170 - DNA, 55140 bp, Escherichia coli
  misc_feature (1)..(55140): first misc_feature region
tgggaatgtttgccgactgggctgtgcgggccgtgctgttttactggcgaatggttactggacgttggctatggaaataccctcgatccgagccgcaaaagtgtgaaaaaaagccagttgtatcggaataaacgacaaaatgcagattatttcagcaaacgatttcaaatttaaaaaacaggctttgacattgtgggtgggcatcgctaatattcgcctcgttctcacgattcctctgtagttcagtcggtagaacggcggactgttaatccgtatgtcactggttcgagtccagtcagaggagccaatttcctgctttcatgcatccttgcgaatccttatgttatttttattcaacaggttagcgtgaaaactcttcccggtgcattttgattttaccctctgcatcgggaaaaattggtagtcaaatctggggtcaggttagttcgataatggagtgacccccatatgtcccttaacgacgcaaaaatccgtagtctcaagcccactgataaaccctttaaagtctccgattcccacggtctgtatctgctggtcaaaccaggcggttcccgtctctggtatcttaaataccgtattaatggcaaagaatcccgtattgcactgggtgcctaccctgccgtctccctgtctgacgcccgccagcagcgcgaaggcatccgtaagatgctggcgctgaacatcaacccggcgcagcaacgtgccgctgaacgcggctcgcgcatgcaggagaaaatgtttaaatccgtggcactggagtggcacagtagcaagaaaaaatggtcgcagaataccgcagatcgcgtgcttgcccgtctgaacagacatgtctttccgaccatcgggcatctaccagttaccgagcttaaatcacgtcatttcattgaattactgaaaggcattgaggaaaagggcttgcttgaagttgcgtcccgctcgcggcaacacctcagcaacattatgcgttatgctgttcatcaggggttaatcgaaatcaacccagctgcaaatcttgacggcgtgacggcttctcccgccagacgacattatcccaccctgccactggagcgccttcctgagctgcttgaacggattgacagttatcaccaaggacgggaactcaccaggcttgcagtcctgctgacgttgcatgtgttcattcgctcaagtgaactgcgctatgctcgttggacagagattaacttcagaaatcggatctggacgatacctgccacacgcgaagcgattgcaggcgtacgttattccagtcgaggtgccaaaatgcgtacaccgcatattgtgcccctttctgagcaggttatctctattctgaaaaggattaaggaaatatctggcgggtatgaactggtgttccccggctatcatgacccctacaagccgatgagtgaaaatactatcaataaggcacttcgccagatgggatacaacacgaaacaagatatctgcggtcatggtttccgggcaatggcgtgtagcgcgctgatggaatccggtttatggtcgcaagatgcagtggagcgtcagatgagtcaccaagagcgcaacactgtgcgtctggcttacattcataaggccgaacatatggaagcccgcatggacatgatgcagtggtggtcggattatctggatatgtgcagtgaaatctgggtgcccccgtacatctggagtcagcaaaacattaatctcgcagtaacctgacttatgaataatcttgtaaagaaccaggccgtatcagcaaacgctgatacggcttttcatccacaggccgtttttcatcttctaagtcgtccaggacatcatggttcttaatacacatgcgttcgcatgtgcttatgttaagtagacttattgtcttacacattttatccgtatcattaaccagaatatgttccggagcagcgggtgatagtgccgccagtccacactcatcgctgcccggaaaaatcatcagtggggaggcaaacggtaagcaccccgctattctgcaagacatttctgcagtttatttaacctccccgaagcatttttataaggcgaggcggtattaaattgaatcatacgacctcgggtccatttattataccaaggtttaccgtaaagctcgtcgttactgaatcgttcaatcaaagccacgagttgctgcttattttcctttaaccgtgccaataaaacttcgtactctgtaatatcctcatagtcacggtagaatttctgtgctaaacgccccaattcattccatttaaatccttcctcaggaaaaataatagtttttccttttgcctcttggtcatgccagtgtaacaccagctctccccagccaatcagataggaaaccagattcgctacgctaatcgtagtccccttcgcgtgcccttccaatagaggttcaaaggcgagttggggcgtaatagattctagcttcttatttaataaagaaaaattactattaatagctttaattaactcttcttttgatgatggaacagccatatctattgctccttgtatagttacacaactatttctaccctactatttcgagtgattcaatcgtctggttcacataacctaccacctgttcaaaatgcttatcgacaaaaaaatgatcggcagcaggaaatataatagtccgcgtctttcgtgtggtgaatttttcccatgcaagtaattcatcctgcattaccagattgtcagcatcgccatgaaatagcacgatcggacaggttaatgtgcgcgccttggcctgaaatacatactgctcatagagccgataatcgtttttaatgatgggggtgaaaattgtcattaactctttattacgaaagacatcaaccggagttccgcccagcttgacgatctcttccataaacgcctgatcgggcaaggtatgcagtattacttcatgagaggcccgatcgggtgggcgacagccggaaaaaaacagcgcgcatggcatgtcatgtccatgatcgagaatataatgcaccagttcgaaggccatgatccctccgagactatgcccaaaaatggcgtagtctccacctgtgtagtgtttcacaaattgttgataaaggtcagcgacggcatccaccatcgtaagacacagcggctggcgtattctagttcccctccccgcaggttctaaaggccgcaaagtaatattgtccgacagcacgctacgccatttataatacatggcggcagaaccacctgaatatggcaaacaatacaaactgatattactcatcgtcccactccttgttgtgtaatagaattcgtttaatttgatgatttaatgtcagaacgaaagctaacaggataattccgaacggtatcgccaacacgctcgatggaccccataccaagataaaacgccagtcaagtcctggagatagtatacccggtgcgacatagagcatggcggccacgagcccaggaaccgccaaggcgatgatatagtcacgtacgcgtaaacgtaacctctgctgttttccagggccatgcgccgttgcgcgataaacacggaaagcaccgcgcactacaaccaccgccccccaaaaacacagcaacaacgtgaggtagacgaaaagggtatcggtggctgtaattgcatcaccagcgccgtcagcatatttgccaatgcgcagataattatcgatatccgcgcaaagctgtagtatcagattcgaattcatatttgccagcgcaacaatgccaatctgctgatccggtcgcaacgcaatgcaagaagaaaagtttggattctgcccaccgtgactgatgtaagggccttgattctggtcgataaaccaaccgctggcatagaggatacgattgtctgcggcaagcggaacatcactattaccacgccaactgttactcatcgcctcacgcagcgttgccggcaaagcctttctgtgcaaccaggcgtctatccatatttccatatcaggcagagtgctatggatataggcggcaggaacatggttccgggccagaggcgcatgaaacagaacgggtttgccgaatcccagtttatagccgcttgccttgttgacaataatctcatcccccttaactgccacagtcgccgacatgcccagcggctgcgtgagtcgttccgcaatgacctctgtaaaggtttttcccgtcacattttcaatcaccgcgcccaacacatcataattggcggaggcatagctaaacttcgcacccggcgcaaacagcagattctcgttgcgcagttgctgtgccacagcgctcccaggcatagggttttccagccgagccagtgttgaaaaaggcaatcctgatgtatgataaaggaaatcagccacggtcagggaagcaggttttccctgataattcaagcgcatttccggcagataggtaatgatatcatccccttgccggagtctgccttcctgaatcagtatttgcaccacaagtccggtaaacgccttactcatcgatcccagctcgtaaactgtgtctagagtattcgctttctgactagccacatcggcaacaccgtagacaaatcgctgacgtacccccttaatggtcacacttacggaaagggctgggaccttggcctcctgcatccgttggtgaattaatgtcgacaggcgctcatcttgcgccccgataggctcatgttcttgcgccaaagcgcacatagcggaaataaagagcagcatacagcacaggagatgatataatgttttaatgctaacgtgttccattattgtcatcctgtgaacacctcataaaataccatcaacacattcggagataaattcactgtgctcacggatagcgggtctggcataaatatcggcggcagtcagtccgattttataaatgtggttacagctgtcgacgaaagagataacgtgcatcgaggtcgctccgtattcgaaaataaccgcgtgttcgtcataatgatcgatgcataacaatgaacgccaggttttctccacaaagtcgctgaccgacaaataactcactggtaacatagcgttctctctcgcatcactggactgaatttcataccggacgcgatcaaacgaataaccgggtaagcctatagtctgcacggctggcatttccggtaaacaaatagtcactcctcgttgccaaagagtgcccaacagcggcaggatgtcctcaggcgtatccgtattcagcatgggggaaaatactgtttgcccaacccactgcgcatgctggtgatacaatatggaaaacgtccccgcgcgaccgatttccagcatcagcgttccctccgtcaccgccagattagccaatatttcgctcagttcactgttgccggccagcgtctgctccggtgtcgtttcagccacaatcacctgctgaacagcgttttccagtgagatgatgcgcgcaacatactgcgctgctgcagcccccgtcaggtaaccgatgtgctgcacaggcgagatactttgttcgatcagccattcactaagactcacctgctggataaactgacgcaatgctggcgtccaatcggctggttcgcagatttgtgcaacatcctgagacaggcgctggtgccgctggcgcaagttaggttgacaagccagcaaatgcgtcagggcactctccagcttatcgtcccggtccggatataggaacaccaaggtagtttccatattgataggggtaaaagacatgtcagcatcccgcagtttcgccaaacttgcacgcaacgctaccacactgtctgccgccagcgcacagcgatacgggaaatgtgcccggcgttgcgcgagagtataggcgatacgatctttatctgcttccgcataggtcgccagagcgtgataatgagcatccaactgttgtctaagggctaatggcgttttggcgctgaagaaaaacaggcggcgctcattttcttgcaccgcttgcgcaggcgtctcgcaccagttttgcagaaccaaatgagcattggtccctcccagcccaaacgaactaacggtggcatggatccttttcgtttgtgggacagaagtcactacatcactgagataaaatggcgaggctggctgcaacagttttttatgtttatttactaggttgatctgcgggggaactaaaccagtatatagcgtcagtgcggttttcattaagctgacgataccggaagcgactcccaggtgacccaagttggcttttaccgcacccaattgaatgctgtgcggcgcacatgccggtgcgaaaacccggtgcagagcttcaagctcaatctcatcacccaacggggtaccggtaccgtgcgtttcgatcagtgcgatatcagtcggtacgacttctgcggcggcaagcgccgtattgatcgcttctacctgtccttctacgctgggggcgacaaaccccagccgacgcccgccgtcgttatttaccgcacctcctttaatcaccgcatacactctgtcttggtcgcgtagtgcatcctcaagacgttttagcaccacaactcccgcaccgctgctgtataccgtgccggtcgcctcagcgctaaacggggcgcagtgtccgtcttgcgataccagcttatcaccttgcggactgtagccgtgcgcctgtaaaaaacccaaggtgaccccacctgccaacgcaacatcggcttgaaaagtcaataacccctcgcatgctaaatatgctgccaccaacgaactggaacaggcggtctgtacactcacagcgggtccggtaaaccccaacttgtaggcaacctgagcacacaagtaatccttttcgttaccaatctgcgcctgaagataatggtgatcgccgctcatcttcaggtatggatagacgcgatcgataaaatagttattggcgtaggtcgccccatagacgccgactcgcttaagttgcgtgggaatatagcccgcatgctcaagagcgttgtagcagcattcaagaaatattcgttgttgcggatccatcaacagggcttcgccaggcggaatattgaaaaatgcagcatcgaagtcatagggagcggtgattatattgcgcagcctaatccaagggttcccattatcgtcttctgtgcatgtcggttgagtgaactcctcacccgccagcaacttatcccaccactcgggcaccgattccgcaccggaaaaacgcccgctcatgccaataatggcaatatccagtgagccacaggtaaaatcatcctttgccattgttgtattccttaagggttggcatcgtgtttatagtgtccacaaagtcggcgcgcccgtcagcgtggcgctgtgttggcacagccaggcatccagatcagtgaggctgttcttgtagcgcgccagcaggagttgcacatcattcagcgcaatgcgcgtgggatcgaaacggcagtggaaggagagaccatcagctgccgagcgcgcaatattaaactccagcacgcagccgagcgcgttttcaggcgcggtatagatatcactattaaagtgatcaatatgaaaatagcggagtgaaggttgcgcctgcacaccgatgtaattcattcggatcccttgcgcaagagagtcttccggtgcatgccgcatttgcagcagaccgtaatctcccccaccatgcgtgcgttttgccaaatcggaagcgatcgcagataacagtgtcgccatatcgccatgcagagggatcgcccaaggataaaatagagtaaaccacccgaccgtatccgcaacgtcaggctcatcgggccagcagccgcgtcccatgccttccatctcgatgcgacaccaaggctcttcgctgtagtaacgcagcaccagcgccaatgccgttagcacataggtttcggcgctgtacgcggtattaccactggattcaaacaacctcctgacgcaaggatggcgaaagtcttcacgccaagcgcgcgtacgaggtaatgagtcatctggcaatgacacgggtgggaaatgcagcggtagcgtttgacatactgtgcgccagctttcgtgtgtggcggaatctaccgttttgctcgccagatagtcattccagcgatgcagtccgctgttgctggtgccattgacagtgctgacggcgtccagcgtgctgaggattaaataccaagagtgcatatcgacgcacaagtgatgggcacagagtaccagcgtgctagacgcaggctgcggggcgtgtaacagagctgccgtaaagactcgaccatttgtcacgtcaagcatgctattgcactgagcgatcacctctgccaacgtccactgcgccgtcgaatattccgtgagcacctcgttgggataacacacattagggtcgcatactagcaaccgcccctcagcgtccagcgcactgtgcaaagctggctgctgctggattaatgtatgcagcctgttgtgtaactgctcgagcgggcagcccggcaacactttcagcacaatgacatggttataaacattgggcactggcaacgccaactgcgtaaaccaacgcaatgcgggtagatcgatacgggtgttatgagcatactgcgcgagctgtgacaccgttgtatgactagcgagaaactcacagatggcgttcactgttccacactccatcacctgcaccgctgacatcgtccagccgtggtgcctgagctgcgctgcaatctggatactcttgatggagtccaaccccaagacataaagattttcgttatcatcaaactcagtttgctccagcgccccttccacacatacccgaactgaatgccttatcgccgcatctcccagccgctcgctacccgatgcaggcgcggtgtttcggaccgttgcgaccatctgacgcacgtccaccttgccattgtgcgatagcggcagttgggcgatagcacagcactgcttgggttgcatgtaggtgggtaattgctgacgcagatgttgcattacggtagctacatcaacagatgacggtgtcacgcaggctagcaacccgctgtgctgcccctgcacatcatcaatcaccgccaccgccgcactttctacctgaggtgcgctcaacaacgcttgttcgatttcgcacagctcaatacgatagccattaattttgacctgatcgtctttacgtccctgataaaccagcgtattaggagcgatggcgtagccaatatcaccgctgcgatagccaatcatcaccccattggtatctttaaggtaggcggcggccgtttgttgcggcgcatcgatatagccctgcgtcactgacgcgccataaatcaccaattcaccagtttcgccttccggtaccggacagccccaaggggagcaaattgctacctggcaaccgtcgatcgccataccgatgggcaatgaaggcagcgtttcttgcccggtgtagcgatagatcatgcaaccaacggtggcctctgtcggcccatattcgttatagatcacggcctgaggaaagagagcagccgccttacgcgccagatcccgcttgaaatcctccccgccaaccaccaaggtacgaatctgctcactgcttatgccagccgcacacaacaaccgcaggtgtgcaggcgtcagtttgatcactgtgttgggctgatcaaccacggccatgcgcagcaatgtttcgctctcggcgtgccgacaaacgctgatgctagcgcccacacataagggggcgaacagcgtagtgatggtcaaatcgaaggacagcgaagagtagagcgcagcccggtcctgcgctgtaaagtaacgttcggcggcgaaatggagatagttagccagattgccatgagagacttgcacgcccttaggctcgccggtcgatccggaggtaaacagcacatatgccagatcctgcggttcaatagctggccaaggttctctagcaagcgccgaagtggctaaggcctggagcaagctggacgcgggaaacgccagcgcctgcgtcaattcatgcatcgccggatcgtaaaggatatgcgctacctgcgctttacgacacatggcgtaaaggcgggtcgttggcaacgcgggatttagcggcagaaatgccgcgccgcagcgcaaaataccataaataaccatcaccgtttgagcgctatgctcagcgataatcccaaccacttgaccgcgtccgatcccctgttggcgcagataacgcgcaacccgctcaacagcgtcatccaactgccgataagtcaaagactgttcattatcaattagtgctgtgcgatcaccatgctccacaacttgcgctgcaaatcgggaagtaaatgagggtttgagtgagccacatgccaatgcgacgtgcggcgcaggatagacttcgagatcgcctagacgagcgtcaggttgccgatccaatgcagtgactaaatccaacagcccatttttcatcgctgtcagttggtgcggagtgaaagcgctacgcagcgcctccagactcaacctaaggctttctttatgattattaacagtttgcaaaacaatctgtagcttataggactgctcgccgctgtagtaactctccacgcgttgcgcggcacctgcaatgtggcgttcataggtaaagttataataattaacgcaataatcgaacgcccgcaacttccctcccccctgttccgccaaatcctggttgaataaggtaatgggatatttgctgtgtttaaaaccgcgtttcagttcgcgctggaaaaaggccacccgttcacagaatcgttccgtgcgcaccagtcgataggccagcggcaattgattagtaaacatgccaaagcaacgccgcgcctcgcgagtatgccgattggctaacggcacgcctattacgcctttttcctccccccatactctggcgcgatagagagcgaagagtgcaataaacagcgtattaagcgtacagccataacgattacacaacctgtagagacggttaatcatggctggctcaagccaagtggaacaactgatgccctcagtagtaacgatgggggaactgtctggaaagcagtcgcggtattcgtcgatatagtcacgccaccagccacgatcaacggcaaagcgcgttgacgcctgataagattgctgctgcgccagaaatgcgctataggctggtgacgcatcatctggtacgtcctgctgttcgtatgctcgcttgacatggtttgacaacaacgccattgaccaaccatcagcaatgccgtgatgggctttaaataaataaccgctgtattgttcaccgcacgtaaaggtgacaaactcgaacaaatcgtgcgccagcagggtaaagggctgccggaaccactcatcaacaaatgtttcgatcgccgctgggcgtaggttctccttgtcataatctggggaaaaagtcaaatggcggatatcgcgccagtgataaggctgcacttggctgaccacttcactctcctctcccatcacaaaccacatacgcaacgcatcaaattgccgaatggcggactggatggccgcgtgtagtcggggcagatcgacaattccctcaatggtgaccacaccaccaatgatgtttacggcactgtaaggatacagttgatcaatgatgtggcactgttcctgtggccacgacaacggattgcccgacatcatggtgccacctccatatccaagtgttgggagcgcaccgcctcctgattccatcgcagcagacgaggtgaaagacgcagcagacgccacgccaacaacgcagccacaaaagtgccgctcatcgccccaaaatagacgccggtaatacgcatctctaacacaatcgccagcaggtatacgacagggacagatataaacacgtgacgcatcagcgtcaacaacaccgaataccaaggcttaccaatggcctgataatattcacttgctaacaggctgatagcgacaaagggtagtgccagtgccatgatacgggtttgcagtaccgcatagtcactcacggcaacaacacgagtaaacaggggatacatccagggtgccagtacaatatgcataacggctaacaccagcacaatagagaaggccagcgcgacggcggcccaataggcattcagcgtgcgggtgacatttccgtgtccccagttttgccccaccacagtcagcaacgcggtcgcgatagccagcatcggcgtgatgatgaaatagtcgatgcgaccagtgagcgtaaacgctgccatcgcgtttacgtccagcctgacgataaaaaaattataaatcactatgccgaccgcaatgatcagttgcatcagcatctgcgccatgccgacggagagaaactctcggtagattttccaggagaatgggcgtaacgcgatgcgtatactcaacccgatatgtaatcccatcaatgtgtagatgaaataggcgaccatactcagttgcgccagaaacgacgccaatgccacccctttcacaccaaaatcgaatacaaagatcatgattggatcgagcataatatttaccaacgcccccaacaatgaggccttcatgatgaccatgatcttacccgcgccttgaaacagccccatcatgacgccaatcaacatgatgctgaacacggtcagcagcgaataataatagaactccgttgcgtagccgatgatgctcttcgtggcccccagtgagcgcaatagcggctgggcataaacatagccaagtacggtgatcacgatcgcaaagaatagcgcgatgatgataccgaccgacaaaatccgctgtgcacgatccaaccgctgcatgccgatggcgcgggacagcaaagatcccataccgatttgaatgccgttggcgatggcaaataaccccattccaacggggaaaaccagccccacaccggcaatgatgccgctgttggtgacatcaatgtggctcagccaaaaaatatcggcgatggcataggtcacctgcgttaacataccgacaaacatcggcaacgccatgcgcaggagtaatttatacagcgagccgtcaaacatacccgccaccgtgaacagctcatcgttcggcgtgccgttgtctggctcaagcttattcaccgtcatacctgctccttattcattaaatgcgccgcacctttattggcgctgtcaccgatatccgcctctagtacccttccggtaccgtgaatccgccactgatgctttcgcagaactcagcaaagttaatcgtcacatcatcgtgaaaatgcccggaaatgatctgtatgccgcacggaagctcatccatcgttttcgccaatgggtaaacggtggcaggcaaaccaaaaaccgttgctaacatgttccagaacaaatgttcgttgtaatcttgcggttcgccattgacgataagcttgcgcttacgcaccggctgctgcatgtgcgcaaacgccagcaccgggctgacaggtgtcaacaacacgtcataacgcgcgaaaagggtttctatcacccggctgtattcgtggcggagtttgtctgtattccgctgttcgccactgtctttcagcatgccctggtaatagctcgttatcccctcaggcacatccgccagcttgcccacaagcctgaagcccagcgcagccagcccggctgtaagacgctggcgtccattgagcgccgtacttaccagccgaccactgagtttgactgctatatcaaacagtgcgtcgggatcgatatcggcgggcatagcatcatcaacctccacgccaggctgtgcgcgtaacttgtcgataaacgattgaaaacgctgtgcgatctgttgatctatctcatggtggggcgcactaaaccacgtgcacacgcggtagtttgctttggcctgataacggctaaaatcgggaatacgcggcggttccacccagaatgtgctcaatgcgcgcatcatcagacgcagatccgccgcgctgcgcgccatggggcccgccgtcgagagatccggctcatcagtcgcttgcggaccaccaccgggcacatgtcctctgaccgacatcaaccccaagctacaacgatgggcatagacacctgtgtagtgtgcgggaatgcgcagtgagccaaacaaatcgctgccaaattccacgggggtgaaatccgccgccaccgccaccgccgctcctccggacgatccgccgggtgaacgttgcctatcccacaggttatgggtggtgccatacagatcgttataggtttgccaatcggcagtcatcatcggcacattggtttttcccatcaggatcgccccggcagcgcgtaagcgtgcgatggaaggagcatcctgcgtcgcccggttatctttcagataatgggcaccggacgtggttaaccacccttgcacgtcaaacgactccttaacagtacaaggtaatccgtgcaacacgccccttgcgcgcccctccagtcgctcacgatcggcgcgcgcggcggcctccaacgccaacgcatagtgctgctgcaccaccgcattcaacggcttgttaaactgcgccatacgtgaaaaatagtgattcaccaacgccactgaggtggtttctccggacgccaactgtgccaacagtgtccctgcgctacgatagctctgctcactcatcgcccttttctccctgttgggcacgtttacgccgcaacgccagattctcgcgcgcagcgctgacctgcgaaacctcagcctgcgctaatacgatatcgtgggcggcgggtagattgtgcagttgctcatcaaggtaacgcgccacatccgcgatggttggcagacggaacagatcgacaatgggaatctcctgcccgataatcgcctcaagtgcctgctgaatacgcaccaattctatagaactgccccccagcgagaagaaatcgtcttcggccgacacgtggctcacgccgagtacctcctgccagagcgccaccagccgctgttgtaacgcactgtccacctggattggacccacgccgtcacgctggtgggcaatttgttcgccctgcagctgtaatttttgccgatctagcttgccgttagcggttaacggaaaatcggtcgctaacatcagatcactcggcaccatatagtcaggcagttgctgacgcaggccgcgcagcatggcatctttgtagctctgcatgtccagcggcgcagcggtttccttcggtttctcataggtggagaaatcgcgcagcaatgctgcagcacttgccgcctcttgccctatcgcgccccccacggtgcaatggacatagcgatgatgtggcgacaattgaaaatgcgatgccacagcggaaaagtctgccatcccaagttggcacagccccaatccgtagcgcggcgcatcttcttccagtaaatggcagagagtacctgcttccatcaccgagaagtgccaagctgcctcttgcccatagaatggcgagatcaccgccatatcagccaccataaacagcgtgaatgccgcccgatcggcaatagactgattaggtccggcatgaaaaccactgttcagctcgacttctggtgctaccggcataagacagctctgtcgcgggtcgaagtagtaaataccggatactccctcttcgatcttgtctggatgcaggtacacgtaggtttgcaccgggtatagccccccggcggacgcataggcatacttggcaaaaggtagaccgggtagacgcatctgccccaagcccgacagcaattgccccaactgtgccagcgtggttttttgcgcgctgaaatgacgatagctgcggcgtttgatgtaacgtgtgctatccgccggtgccgtcagtgcaatgcccagaccatccagcgcgcgaatatgtggctccttgagtttgaacgctagacgctgtgccggattcacaataataccctgcgccagtgccgccgcctccgcttccttagcttgcaatgcctgcgcctggtggcgatcgtgcagtttggcaaaagcgaccagccgacgatgttgagaattacccactgccaccaccactgactgctccacatcgggatgtcgcgcaatgcagcgctcgatttcccccagttcgatacggtaaccattcaccttcacttgggtatcgttgcgccccaaaaaggcgacttgcccgtcagcaaagtagcgcccgcgatccccagtgcggtaaattcgctcaccactcgcttcgcgccagacaaagctcgccgccgttttctctgcgtcgttcaggtagccttgtgccagccccatcccgccaatgcaaatctctccttccaccccgaccggacattcctccagttgcgcatttagcacgtatactggctggttgcgcaggccccgaccgtagggaatactggtccacgtcgattccacctcacctatcgggtagtagaccgaccagatggcgcactcggtcgctccacccagactgatgatgtccatcgtttcattgagccgctcgcgcatctgctccggtaacgttagcgggatccagtcgccgctcaacagtgccagacgcaacgtcggataactcatccgatcgccgctgtggtattcgcacagcatctgcatcagtgcgggcactgcattccagacgcttacatgaccgtgtgccataactgtctgccaatgacgcggatctttttcccgtcctgcttccggcagtaccagcgctgcacccaccataaaaggcgcaaaggcatcgtaaaccgacaggtcaaagctcaatgatgacagcccgaacaccctatcctgcgcattgaggccaaagcgttcgttgatgtcttccagtgtgttcatggccgcacggtggtcgatcatcactcctttcggggtaccggtggagccggaagtgaaaatgatataggccagatccgtgacatccccagccacttcaggcaacggcgcagcaggcgtgtccagcattccgtcgtcgatgatcagcacgggcagcgacggctccaattgcgtgagacccggctgcgttacttgtacccgcacctcgcccaccgtcagcaaaagctggcgacgctgtggcggtagcaccggatccactggcagatagaccgcacccagtcgtaaaatgccgtgtacggcggcaatctgctgccagcctttttccatcaccaccgccacgcggtcgccatgctgcacgcccagcgctaacagggcgcgggccacatgatccgccgccgtcgacagttggcgataggtcaattcacggataggactgatcagcgcagtttcctgtggcgtcagtgctgcctgacgcagtaacccatggtgcaacaaggccgtaggtgcaggagcctgcgtgaccggtgcactaacggtgggcagcgccagcacatcttgagtctcatgccagagctgtggtcgctgggctagggcgtgcaggagttggcaataacactggaacatctgatccattagcgccggttcaaacaattgttccaccacgtcccaattaaagtgcaattccccgttacgctccattacctgatgatcgagccacacctgcggtgtctgtgaaatactgtacagatcatcctgcggttggttgaacagcgtatcatccgtttcccagctcgcctcatattgattgagcaagctggtgaacacgataggaatcaccgatttcgccggatcgcggtgagtttgtaccagcagtcgagagacctggataccgccaaacaagcggttatccaaatcgcgccacagttgagagtggatcacgtttgcccgcgcctgcaaggtttctccctgcgacatatcaatctccagcaacgtcagtgcagtaaaatcgccaattaagtgattgatatctgcgtgcaacggcagacgattaaacagcgtcaggttaaggctaaagtgcggcgaggaactaaagcgcgccaacacctgagcaaaccccgtgagcagcagtgtagtaggcgtgatactcatctgacccgcctgcgttttcaagcgctgccagatagcacgagatagacaatagctacggcgcacgaatgtggggttttccagcttcgtggggtcggtacgcagcggcaatcgtggccccggcggcagagtttcgatgcgggcgcgccagtagtcacgtgcccgttcaaactgcggcgttttctcgtaggattttaaggtcagcacatagtcgcggaaactgtacgtcaatgtaggcaatgccgcctgcggatggcggtagtgataagctagttcccgaatgaacaactccagactccatgcatcggctatcagcaggtcgatagatacatgtagccgggctttttgctgcggatcaaccacgacctccatctgaaacagaggccagcgactacaatcaatcatctgatgtgagagggtgtcacgcagctcacggcaacgctgttgaaacgcatcctcgcactgggtggtatagaaggcaacgtggtattccggcacgtttggcaatatctgctgcataccgtcatcgttgacaattgcacgcaacatgctgtgccgcgcaatcaccgcattgagcgcgcggttgaacgctgtttcatctagcccctgtagttcatattccacatagatatgggtggaaatattgcccaatcccaaggattttcgccgcccaacccaataggcctgttgcacgtcagtcagcggaaaaggtaggtgctgctggtcaggggcaaagaccgtatcaggcaatgctgaaaccgctgtctcactgccgccttgttcgagcagatagcaacttaatccctcgatggtgggatcggcaaagaatgcgcttagcgtacaggtgatgccgtaacgttgctgaatatcatataaaatggttgacgctaacagcgaatgcccacccagttcgaagaagctggcgtggtgatcatcaatgctgacaccaagcgtgcgttcccatatctccgtcaccactgcaataatatcggattttgttgcgcgggataagagattattcgacgattcgtgggagaacgtggcaggccgtacggcctcgacccaatagcgctgcggtgtaaaaacggtccccggcagggcgatgcgttgactgcccaacatacgctccgccgcatccacccagcgccaatctaggctgacgccagccaaccataactgccctaacgcctctagcgcggtgcgattggcatcactcgccgcgtcgtccagcatcaaagagcagacatcgggctgcaagaggggattcgtcggcacatcatcaaacggttggcccgcattcaacctgtgccatgcttgctctagtgtgcagtctcctcgtagtacggcggcagcatagccaccatcaccgtcgccgcatagcaccacattcaacgtttcccgttcgtcaatcaacgcgatcagcgcatactggctgataaacgtccgttgcgcaggggagagatcttgcagacaggctggttcgagcggaaaatgctcgagcagttgtcccaccgcctgtgacaacacctcagagcacgccagccagtcactaagcgtctcgagtgcaacaacgaaacggtgccccaatctccagtagatcgtgcaacccgtggttgcctccaccatcggtgcgtcgcggagttgtcgggctagctgggtgcaattctctgcgatgacacacttacgtaccggggcggagaaacgcccgtgacgcagggtgtaagccacgtcctgtaagcgtatctctggatgtgcggccagtttcgccagcagggcgttttgcatctgttccagggcattgtggttttttgccgagagtacaacgacacaaggccccatctgctgcgccctcgcctgcggcgtcgataacggcgcttgtaccaccagatgtgcgttggtgccgcccaatccgaacgcactcacaccagcggtgcgtggcgtggtgccctccggccaaggcgttaaacgggacaccacttcaaacgggctgtcctccaaccccagttgcggattagcccgttgaaaattcagcgtagggtaaaacacccggttagtaagactcagcaccgtttttatgagactggtgatgccagatgccatttctacgtgacccacgttaggtttcacagcccccagacgccacggtgtcgcattcggcgctggcgtcccaaacacacgtttgatggccgcgaattcgatagcgtcacccaacggcgtgccgctgccatgcagttctagatactgaatttgctgcggcgtcacctccgccaagctatgcgcctcaatcatcacagcttcctgaccatcaacacccggcacggtataaccactgcgcgcaccgccatcattgttgatggcgcttcccttgatgacggcaaggatgttatccccttgcacctgcgcgtctgtagcccgtttgagcagcaccatgcccaaaccactgctgtagaccgtaccgctcgcctgcgcatcaaaagtatgaatcaggccatcctctgcttgcagcccatcaccgtgcgattcatagctgcgctgctcctccatgcgaaacgtgacgccacccgctagcgccatatcgcactgaccgctcagcagcccttcgcaggccagatgcactgccaccagcgaggtggcacaactggcctgaaccgtcacgcaagggccggtaatattcaggcggtaagccagttgggacgtcaaatgatctttgtcattgccgaccatgatttggagaccaccgagttgtgcaagcttgtctgggttgttcatcaggtgagtaagcaaatagaagctggtactcacgcccgcatataggccgacgcgcgcatcgtgctgcttcgggttgtaaccgctttgttcaaacatctcccaagcacaggtcagaaatacgcgctgctgtggatccatgatttctgcttctgcacggctgtagccaaaaaagttggcatcgaactccgccatgtgctcatagacgttgttcagcgtaatgtgattgtggccgttgctcggggtcactttggggtccaaaatgttgcatccggtgcgaagcaccgtttcgaatgccgcaacgctgtgcacgccggggtaccggcagttcatgccaacaatggcaatatcgctttcactgtaagtcattagtttttccttaacgctgacgctggtgacgacgtacaagtcgttgctgggcgcgggatcgggaagcatcacgctgctgtgtttgattcaccgcccgtgcattgtcctgcatagcctgcaaataaccggcaattcttttcacggtggttaagcgaaatagctcagcaataggtaccgtaaccttaaaaatctcctcaatacggcgatgcaacagcacgatctggattgagccgccccccgcttcaaaaaagttgtcattcagtccgatctgttctcgttgtagtacctcgcaccagagagcggccacctgctgttcatagggcgaggcgtgcgcgagggccctcgacttctgtgatgtagattgcgacatacgttggataacctcttgaaccattgccgcctgatcaattttgccgttgcctgtcatcggcagcaccttgagaagaaagaaatgttggggcagcaggtaatacggcaactgcacggctaactgagcacgaacacgcgctaacagggcgtcagtatcgtcaggatgcaggttttctgcggcagtgataaaggcatacagctgtccctggtggcacaccacggcggcactccctacgctgtcgagctgttcaaggtggcttttgacttcccccagttcgatacggtaaccattcaccttcacttgggtatcgttgcgccccaaaaaggcgacttgcccgtcagcaaagtagcgcccgcgatccccagtgcggtaaattcgctcaccactcgcttcgcgccagacaaagctcgccgccgttttctctgcgtcgttcaggtagccttgtgccagccccatcccgccaatgcaaatctctccttccaccccgaccggacattcctccagttgcgcatttagcacgtatactggctggttgcgcaggccccgaccgtagggaatactggtccacgtcgattccacctcacctatcgggtagtagaccgaccagatggcgcactcggtcgctccacccagactgatgatgtccatcgtttcattgagccgctcgcgcatctgctccggtaacgttagcgggatccagtcgccgctcaacagtgccagacgcaacgtcggataactcatccgatcgccgctgtggtattcgcacagcatctgcatcagtgcgggcactgcattccagacgcttacatgaccgtgtgccataactgtctgccaatgacgcggatctttttcccgtcctgcttccggcagtaccagcgctgcacccaccataaaaggcgcaaaggcatcgtaaaccgacaggtcaaagctcaatgatgacagcccgaacaccctatcctgcgcattgaggccaaagcgttcgttgatgtcttccagcgtgttcatggccgcacggtggtcgatcatcactcctttcggggtaccggtggagccggaagtgaaaatgatataggccagatccgtgacatccccagccacttcaggcaacggcgcagcaggcgtgtccagcattccgtcgtcgatgatcagcacgggcagcgacggctccaattgcgtgagacccggctgcgttacttgtacccgcacctcgcccaccgtcagcaaaagctggcgacgctgtggcggtagcaccggatccactggcagatagaccgcacccagtcgtaaaatgccgtgtacggcggcaatctgctgccagcctttttccatcaccaccgccacgcggtcgccatgctgcacgcccagcgctaacagggcgcgggccacatgatccgccgccgtcgacagttggcgataggtcaattcacggataggactgatcagcgcagtttcctgtggcgtcagtgctgcctgacgcagtaatccatggtgcaacaaggccgtaggtgcaggagcctgcgtgaccggtgcactaacggtgggcagcgccagagaactatttaccccccaccaactttgcggcatggcaaccagcgcctgcagcgcatgacaataagcaccaaacatctgatccagcagcgtggtatcaaacagttgctcgaccgcgtcccagttgaaatgcaactccccagccaactcgatcacctggtgatcgagccacacctgcggtgtttgggtaatattggcgtccggacacagagtaaaacgggttgtgtcccgagggtcttgcgcagtcgtctccccgtcgatatccaacatactagtgaataccaccggcatcggcgcatggaaacgaccgctatggatcagcgcctcgctggcgcggatcccactgaaacgacgatgttcgagatcttcccacagttgcacctgaatacgctgagcgttgtgggcataagagtgctggctgtcgtaacaaacattcagcaagctgacagcggtaaaatcaccaataactgcctctgcgttggggtaaccctgcgggcggttgaacaacgtcagattgagcgtaaacgtcgggctaaggctccaacgtgccagcacttggctaaagactgtcaacaacaatgccgtcttggtgatacgtgtgcgttgggccagcgcgctcagcactccccagttgtgggctgacagccgatgacggcgacgtacgaacctgatcgcagacagttgcgccaaatcgccctgtacgggcagcgttggtgggccatacagctgcggcagcgcccgttgccaataggcctgatcgcgtgcataggcttcactcgcctgctctaccaacagcgcctgcacgtagtcacgaaaagagaacggtagcaacggcagtgacacatggggctcacggtacagcatcatcaactcctgctgtagcgtgcgcatactcagagcatcggcaatcagcagatcgagactgaaatgcaagcggccatgttgcgccgtgcaagccgaataactgaaatcaaacagcggccaacgatctgcgggatgcacatgatgcgacagccgatcgcggatcgccatcaaggcatcgtttcgtgcgttaggggacaaagcactcagatcgcgctgctctaactgatacgccggcacttgcgccagaatctgctgagtaccgtcggggagtacccgcgcacgtagcatttcatggcgagcgatcagcgcattcaccgcatgggtaaaacgcgtaacattaaagtgttctacgtcaaattcatggtagatgtgggtcgcgatcgaggtagcacccgtctgtcgtccaagccagtaggcgcgctgaacatccgtcaatgggaacggttgatgacgatgctcagggtcgtgcactatcacccagtcatcctgagacgcggcagcgtccgtgatagattgctgtgcaatacgcgcactcagtgcccgtagtgtggagtagtggaaaatgtccttcagggtcaaggcgcagtgaaaagtgcggttgatctctgctaccaacgttaccgccaacagcgaatgtccccccaagcgaaagaaatcgcactcaggatcgacgttttttatcggcaaatagcgcatccacagcgccagcaacatctgttccgtgtcgctcagcgcttgcgtctgcggcgacacaagggagctatcggcaacgaaattttccgctaaccgcttacgatcgattttaccgttgtcagtgttcgggaagtcggccaccctctgccacagcgttggcaccatatagtctggcagttgctgccgaagctcgtttttcagttgctcgaatagcgagggaggctcactggtgatgatgaatgctgccagtgctttgtgtaacggtgctctttcaatacaggccaccaccgcggcgtccacatgcggatgccgtgccaacgtccgttcaatttcgcctaactcaatacgataaccgcgcagtttgatctggctatctttgcgcccaacaaaaaacaactgcccctgcgcatcactcctgaccagatcgccagtgcggaacatcctgccaccggggacccctggttctgacaagaagaactgtgcgttcaactcaggctgcccatcatacccttgcgccacaccatccccggcgatgtaaagctcgccgtcaacgccttgcggcactggatggccctcattgtccagaatgtatatacgggtattggcaatgggagcgccgagggtgatgttttccgcttgggttatctgcgatttcagcgaccaaatggttgtttcggtgggaccgtagaggttccacaatgaaccacaacagcgcaacagttcttccgccactttcgttggcagcgcttcaccgcctgccagcacacatagttccgggtcgccacgccaacccgccatcaacagcccgtgccagaacgagggcgtcgcctgcatcagcgttggtcgatagtcggcaatcagcggaatcatacggaagctgtctgcggcgcgttccgcctctgtcagatagagactcgcaccggagatcagcggcaacagatactccaagaatgagatatcaaatgttggcgtcgtcaccgagagcagccggtcttgcgagccaaccgcaaaggtacgctgcatatccaacaacaagttcagcaacccgcggtgaacaacgcacacgcctttaggttcaccggtactgccggaggtaaacaacaggtaggcctgcatatccggcaacagcgcgcaaggtgtagaataccggatcgcattcgacatgtcctgcatcaattccggcaacgacagttgtacaatttcaccccactctcccggctgacggaccaccagacagaccaaacgcgcgcgttgcataaggcgttgcaaacgcgcggcaggctgatgaatatcgaacggcacgtagcacgcccccacaaaccacgtcgccaacatggttgcaatcacatccctgtgacgtggcaacagcacgccaatacgatcgcccggttgtatgccatgcgctcgaaaacgcatcgcgatgaactgcacacgcgcccagagctcagcgtaggtcagtgtgccgtcatgctgctgtattgccagttgctttgggtgctgcacacagcgctgttcaatgatacgcagcacatcctgcggcccgagccacgggacgttagtggcgttgagcggatcacgccgcggcgttgcggtctccggtgcatgcagagggatcgcccctatcggggtctccagtgatgatgtcaacgataagcagtgctgacgcagcgcctcggcaatctgcttcaccacatcagcatcgtataaccccaaatcgtactcaaaggagacgtcgaacgtggcgtcgttttggaacacctcgactgtcatgtcgtatttgacggtctgattgtgatacgtcacctgctcccaatacgcaccagccaaggtaaaagcgcgtggggtcacgtggttatggtagatatagaggatctggaacaacggtgaatgggaaaggctgcgagggagatccagcatattcaccaagttttcaaacggcagttgctggcgcccctgcgtctctttcacgctggccttcacacgctggagcgcctcgcgccctacctcaaccccattaaaatcggtgtagataaccgcagtgctggcataataaccaatgctactctgcaattccgggcgaatgcgccccgatactggcatgcctatcaccaatcgctgttgctgagcgtaacgcatcagcaccagttggaaggcagtcagcatcagcacgaacggcgttgtttcctgcgtgcgggctacgtgtttcaacgcgaggcttaatgtttcatccagggtgatgctgaaccgggaaccatgtgtagagggttgtgccgggcgcgggtgcagcgatggaaatgtcgacagcagaggcgcgtcttgcaaacgcgcacgccagtaggcaagttcgttcgccagcaaggtatcctggaaccattcgcgctgccagaaggcataatcggcatattgcagcggcggcggaggcagcgacgtttcattaccagcatgcaatcgagcatactgctgctgtaactcatcgaacaatagccgtaacgagataccgtcgatgatgatatggtgcgcgcaaaacaccaaatgacaaccttgatcgggttgaataatctgagttaccccccacagaggaccgcgtgccagatcgaaccgggtgtttatcacctgctgaattaccgcatctagcgctgaagttggggcctgcgctgccagcgtgaccgtatcgagaactaacgaagacgcatcatctatcacctggcaaggccgatcgttacgtactatgatacgggtacgcaagatggcgtggcgtgcttgcacatggcgcaatgcctccgtgagcatcggcatatccaccacgccatgcaaacgatacaccacataaaggttgtagttagtggcggtactgtcgtatttttgcaaaaaccacaaccgctcctgattaaacgacagcgggattgcctgcgccggatccgctttgatgatgggaatgcggctgggcgacacgcctgattgcgccaactgtcgtaatagcttttcctttttttccgccggtaacattcgcgccaatgcggcatgatgtatcgtcatgaccgtcctttccttttcgctgtgttaaatacttttgccaacgtcactcattaatcatgtcgttaactagcacggcaagtgcggaccctccatcatcctgctgctcctgctcgaccaactgcgctaacgcgcgcacgctggcatcctccatcacgtcgaaaaaggaaagagtgacggcgaaccgttcctgtacctgcgccagcaacatgcccagcatcaatgaatgtccgccagcttcgaagaagttgtcgtcaatgcccaagccgtcaattcccagcaatgcttcacaaatcgccactaagccgcgctgcgttttgctctctggagccgcgtaaggcaccgaaaacgccggacgcggctgacggcgcaccgacggttcgctagggatgacacttcccgcgtccgccaccggcgttacggcgctcctctgttcttctggactgtcgacccagtaacggattttgtcaaaggcgtaggtcggtagagagacacggcgcggttgctcacctgcaaacgcagacaaatcgatgttatgccctcgcacccaaagcgctgccacggtatctaagatatgtttgtgctcatcgctgctgcgggcacctgctggcagcgagctgaacgcgagacgatcacctaatgcatgaccgttggtcagctgggtcagggtggcacctggcccgatttccagaaaatcgacatcaaatgtagcttgcgcctcttgcagtgcagcggagaactgcacaggcatcagcatctgttcaatccagtagtccggtgtggtgagagtgtcggcactgacgtgcgcgccggttacggtagagatgatggtgagcgtcggcgggttcagtcgtacattctcaaatgcctgacgtagcgcctgcgccgcatcttgcatcatgctagagtggaaggcatgagaggtatgcaatcgtttgttgatgatgttctgctccgtcagacgctggctgacggcgaggatctccgacgtaggcccggcgataaccgaatagtcaggggcgttaacagcggcaatcgccagcggggcggtaatcagtgcgcgaatctgtgcttcgggcagcgccaccatcaacatggcaccgcttggtgcctgatgcatcagctctgctcgacgcgccaccaagcgcaacgcatcctctaaagagaacacgcctgccaacgtcgctgccacccattcgcccagcgaatgaccaatcattaccgttggcgtgattccccaactgagccacaattgggctaaggcatactcgacgctgaacagcagcggttgtgtgaggcaggtttgcgcaaggcgttcgccttgggctaacgagacttctgctctgaacaactcatggcggatatccagttggtattcacgctcgagtaacgtcgcgcaacggtcgaaggcatcggcgtaggccggccaaacctgatagagctgatggcccatgcgctgatattggctaccctgcccggaaaacaacagccccagcccgagctgtgtctgcgctacaccacgagcaaacggcgctgtcgcggcctgctgcaacagcgtcccggcagcatgtagatctctggttacgagcgcggcgcgatgtgcgaaggctttacgtccctgtgagagtgtccacgccagatcccgcctatccggcagcgattcatgttgcagaaaatcggcaaaacgcgccagccccgaggataaggcactgtcggtcttggcagaaaacggcaaaatactgtaggcaggtacaggcgctcgcgcttgcaagtcaacggctggcgcttgttccagcacaacatgggcattggtgccgcccatgccaagcgaggtgacgcccgcgcgacggatgccgctttccggttgccacggttgacaggtagtgttgatgtaaaacggactattggtcagatcgatctgtgcattgggccgttcaaagtgcaatgttgcgggaattattccctgctgcactgccagcgcggtttttatcaaccctgcgacgcccgctgccgtatccaaatggccgatattggtttttaccgaccccagcgcacagtactgcttttgtgacgcgcccgcaaaggcttggcttagcgcagaaaactcaaccggatcgcccaaacgcgtaccggtaccgtgggcttccacataagtgatatcctgcggtgtcaaacctgccaaccgctgtgcctgagcaatggcgcgcgcttgggcatccacgctcggcgcggtataactgatcttctccgaaccgtcgttgttgacggcaaatcctttgatgaccgcatagatgttatcgccatcacgcagcgcttcatcaacacgctttaacaccaccagccccgcgccggtgccgggcacaaatccgctgctgttatcggaaaacgcccgacagtggccatcggcggcggtgatcccaccttcctgcgacaagtagccggtttttgctggtggccccagcgttactccgccagcaatcgccatgtcacactgccaagtcaacagactttggcatgccacgcacaccgccaccaaggatgtcgatgaggaagtctgcaccgtgatcgccgggccgcgcaggttgaggtgataggcgatggtagtagtgatactgtctttgtcgttaccaatggccgcctgcaaactgccagaagagaaaacgcgtttaaagtgcggcatcaagttcagcatcaaataggaatccatgcttttgccagcaaaaatacccacatcccccggataatcggcagccacatagcccgcatcttcgaaggctgcccacgcggtttccaacaggacacggtgctgaggatccatcagctccgcctctcggggtgcgataccgaagaaagcagcatcaaatttatcgatgtcagctacctcccctttggccttgacgtaatctgggtgctgaacaaattcaggactgattcccatcgccagcagttcctcatcgctgtaaaaggaaatgcactctcggcttgccagaagattttcccaaaacgcctgtaccgtatcggcttgagggaaacgccccgccatcccaatgatagctataccaaaatcattctctgccatgttgctttccccctatattcaggtttatcacgcgtttcattcagtggaatcagtgatgactgtcggttgtggctgcccagcgcgtgtgaccaaaggccaaacgctgcttcgccgcacgcagttgtgtctgatctcctgtggtcccttgcgctgcgtccggggccagcagaaattccgccaagcgtttgatggtagtgaagcgcagcaggtcaaccaacgccacgtgctgaccgcactgctgcccgatgtattgctgcatctgtactagcagaagtgagtgtccaccgagatcgaagaaatttgtggtggtgccgacacgctccaggccaagcaactgctgccagatctccgccagacgctgttccagttcggttgccggagggacatactcgcccggcccttccaactgccgcagatcgaccagcggcaggcactggggatcgattttgccgtttacacctagcggcatggcgctcagcggcacgtagagcaacggcagcatatgcaacggaagccgcaggctgagccatacgcgcaattgctgagcatccagcgcaacgccgttgacgctgcaatagaaggccactagtagcggcgttgccgccgcattgcgtcgcacatcgacccacgcatcagcaatatccggatgctgtttcagtaggctttcgatgtcgcccagttcaactcggtatccacggatctgcacttggcgatcttgtctgccgagatagaacaacatcccgtcggttgcccaacgagcacgatcgccagttttcagcacccgaacgccagggtattccggcaactcgacaaagcgctcgggatcctgtcgtgcatcaaggtagccgggcgaaatgcccagaccagagaaacagagttctccacaggcacctggcggtaccaaacgattatatgcatccaccacataagcttgggtgttctgaatcgggcggccaatgggcaatgctcccgtttcttgctccctacgctttgcgacaggaaagtaggtcgagcagataccgctttcggtcaggccataaccgttaaccactgccatgtgcggcagaagcggcgctatctgctcatactctaacgcttcaccaccgcacagaaacaagcgcagcgatcccatcgactgagccagcacagagaggctggcagaaagcgatggggtggtgctcaggatagtcacccgctgagatgccagcagcgcaatgagcgcatcactatccaaactctgcgctttttgcgccaatactaaggtaccgccagcggcgagcagcggcagtacctccccgacaaagctagcagacgcgactgaggtaatgggtagcaaaacatcctgatgcgtcacttgatagctggatataaaggatgcggttaagttgaccagattacgttggctgagtcggacgcctttgggctgcccggtagtaccggaggtaaagatcaccaccgcatcgcaatctaaagcatctggcgcaacactaactggcaggttcggtatttctgtcagcaggctacgccagtcaggcactagcacccaaggtatcgtcagcccatgaggggattccagcggttgcgccaccagcagcatgcacggcgttgcctgcgccaagatcagggcattgcgggccgctggcgcgttaccatccagcggcacatagctcgcccccaaagagaggatcgccaattgtgcgataatcaattcgaaacaaaaaggcagttgcagtgcgacagattctccgcgttttacgccttgcgcacgcagccaagtacacatctgcatcgtggcctgttgcaattcgccataggtcatggcgtcgtcagcgtggcgcaaagccacctgtgtagggcgctgctggcagtgcggtaacactagcgccagcaggttatctacgggcggcagagcaacttcagtggcgttgtgccgcgccagccaagcgtgctctcgaggggtgaaacgaatcaaatcgcggactaactgcgtgggttggctgctggcctcatctagcagttctctccactgcgccaccaggtgctgaatacgatccgcactgtataacccagcgtcgtattcgaaagtgccggtgatgcgcccatcgatatgctgcatacttagcgaaatatccacctgagatgcactggtatccaacaataatggtgtaacgttgacaccgtttagtgtcgggctcgccagaggcatattgtcgagttggaacatgcactgatatattgggaaatgtccggcgctgcgatccacattcactgcgcgcactatgtcggtaaattcgagacgctggtgcctgaaagcggcaaacagaatacctctgatcgtctgtactaactcggaaaacgatgccgcttcgtcaagaggtaagcgcagcggtagtacgttgaccagcggcgcgatcatatgctcctgttctttcgtcagccgcgcagcaatcggcataccgacgatgtattcctgttgacgcgcattacgatgcagcaggaggacgaaggcggtcagcagatagttatacaacgacacgcgctgcgcacgcgccgccgccaacactcgctcgcatgtgttggcagacaatgcgaaggcaacaaacgcgccttggtaacgtgccaccttctgacgcggttgatcggtggggatatcaagaatcggcaacgtccccgccagggtattttgccagtaacgcatcgcgtcctgataggcgtcactctgacgccactcttcttggtactccatgtagtcggcatactccaacaacggttctggcgtcagcgattcaccgttatatgcggcctgcaattcgcgtaacaaaacgcctttcgaccagccatcactgatgatgtggtgcagatgaatcaacaatacgctacgatcgtcatcgagcgtcaacagttcaaaccggcacagcggtgtgcctgacgttaagggcatggggtgtgccgcacgctggttgatcatcgcctgtagcgcgttatcatcactcaccgaggggagtggcactatggtcagcaacgcctgcgacgatacgcactgaggcaccgccaatactggttgtccattgtgggtttccgccatagcacgtaacagagtatgccgactcatcaattgacgaatcgcgccgtccatccgcgtgcgatccagttctccttcaagcagcaaggcggtggggttattgtatagtgcagtatgcggcgccaattgttgcataaaccacatcgacgattgagccgatgacaacggtaggtagcgcacggcgggagtttcacgtaaatcgacgcgactggctgagtacgcccgcgccaagtcgagcaacgttttacgacagcacttgccattgtcggagagtggtaactctgacattgccaacaaacggttcggcagcatgtaggcaggcaagtttttggacagtgcgtccattaaggccgccaaattgagcggcacgctactgacgacaaaagcgtaaatcaactgattgtcgggatcatcctgatccgccaccacgactgcctgctgtacccccgggaaacgcatcgcatgggcttcgatttctcccaattcaacgcgcaaccctctaattttaatctgaaaatcattacggccaatgtaatgaatttgttggctttccccgtcgcgccacaccagatctccagttttatacagccgctccggtttccctaaatggcgcaaagttggatgtatagtaaaacagcgatcagttaacgccacgttgttgagatagccacgtgccagcccgataccagcgagatacagttcgccctcttcgccgtctgctaccggattaccatggtcatccagcacatagagtcggcaaccgtcaatcgcttgaccgatagggatatcgtcgtagtcgtacccgcgcaggcagcggtgatgactgacatcgattgctgcttcggtcgggccatagagatttataagatcaccctgcgccaccgattgataaaagcgagccacactgtggaccgtgagtttctcaccgctggaaaacactaatcgcaatgaggcggtcaaacgaggatcctgtttcatctccagatactcgacaaacaggttcagcatcgaagggacaaagtgcacaaccgacacgcggtgacgctgaatcagtcgagccaaggttcgcggatcgctctccagtccggacggtaacagcactacagatgcgccgtacatcgcccaccagaacatctcccagacagagacgtcaaaggtgtacaccgtcttctgaaacagcacgtcctgagaactgataggataagcgttctgcatccagacaattcggtttagcagcgctgcatgttccgtcgccacccctttagggacaccggtggaaccggaggtgtaaataatatacgccagttgccgcgcatgtggtcggtaacgcagatccgtcgttggcatggcactgaccgccgcgctgtcgatttcgacgcgaggaatcggccagcgatcaccatcgtcagtaccgatcagacaaacagcgccgctgttgctcagtatattttcaatgcggctgcgcggtgcattgtacgccagcggtaaataggcaccaccagcttttacaatagcgaaaatggcaatcagcattgccatgccgcgcggcaggcggatagctaccacacgatcctcgccgatccccagcccacgcagataatgcgccagttggttagagcgtgcattaagatcgtgatagctcagcgccgcgtcccccatcaatacagcggctttttccccatattctccggcgatacgatacaaatagtcgactatcgtttggtcgtcggtaggcaactgtctcataatcccttgctgttccataactctggccttcaaagcgagataagtacgtaaaatggcgtgacgggttacgcctgtccgccgttgtcggaagccaaccgcgcgtggcaggcgtcgatttctgcctgactactgcctttgagttgaaatccctgttcaagaagctcatgcaaaaaagcaatgtcctcttcgctggatgtgccgcgctgctcaatctgctggatgcgctcaaaaaaacgactgagcaattctttcaattgcgcactggcagccacatcggcggcgcggtgatggcgtgtggctgtcagggcgttagtgagcagcgtgatgcgttggcggcgcacggcttccggatcggtcttcaccgccatgttatcccccagcaccaatgctagttgcgcacgatcatgacgattgtcaaatgcgtaaactggtgctggatagcgattctccagcagcaggtttttcagcacactttgcggaccgatctctatcgcgatcggtgacaagtgtcctgtcaggtaggtgagagagcgctgccactgcactggctgagagagctgttgttctagccactggactggcgtgaccgtatcgggatagggttgagcgttgacattggagatcactgggcagcacggacgtcgccattcgcagcgatccagcgccttgcgcaattgctgtccgcaaggtttcaatagtgggctgtggtaaggaacaccaccaatcagcggcactacttcgacttggcgatcatgatccagcaggtattgctcggcggcgataatggccgagttttgtccggataacataaactgttgcggcgaattgaagcaggcaataccgacctgctgtcgggtttcacgctccgccacctcgcacgccgctgccaccagtgcctgattcccttgcttgatgatagtggtactcgcgtccatttcgcgggcgatctcactggctaaacggctacgcatcgccaccagcgccagtgcttgggaaaagctcagcgcaccactacaggtcagcgcagcatattcgcccaaactatgacccaacatataacgtaggttgacatggacaccggtttgcgccaaaaactgctgccacgcgacaaagtgggccacgctggtggtatagatagccagcgccattgccgtcggctcagcaagttgtaccaaagtacccgacaggcacagcgctgccatgtcccgttccgtgatctggctagcttcatcaaacagagtacgcacctgcggataacgctcatacagccaccgtgccatgcctacatattgcgaaccggagccagggaacatcagtgcgacatccttcgtcatgcttcactccccatcatgtaattcatcgcaatttggatttcatgaatttgcgatgtcccttcgatgatttccatgattttggcgtcgcggtagtaacgttcgacggcataatcggcatggcaaccattcgcaccgagcagttgcaccgccttcccggccacgtccaccgcagctttggaagcgacatacttcgccatcaggatttggtttatcatggccgggtgcagcgtttcgcggtattccgccgcgctgaagcacattagttgcgcactgcgcgtttgggtcagcattgtggcaaacaagtgctgaacaatgccatgagaaaataaccgccgcttgaactgtttacgctggcggatgtagcgcgctgccacatccacagcggcccgacataatcctaggctgccacaagcggtggtgaaccgcccttcattgagcgcaaaattcaccgccagcggtaccccaggggtgagcggaccgagcaatgcatcctccttcaggcggcagtcattaaaatgcagctctgccaacatattgccgcgtaaccccaacatgtcgttgagtggagtgatagtaaagccgtcggtattgcgatcgataagcactgtcgctaattgattaccacagtggattaaaacaataaaaaaatcagcaatctgccctagcgtgatccatttctttttcccgttcagccgccaaccgtcgccatcctgctgtaattctgtttccacgttcactaagtcactgccgatattcggctctgtgagggcaatcgcgccgatcaattcccccgttgccagctttggcaaataatgggctttttgcgctgcgctgcccacgcgttgcagcagcgtgctgaccatgccagtcactgttatgagattttctaacgaaccgtgaaccccagccatcacttcatgcaaagcgcacagttgataagaatcgtaacctcgtccgccatatttttgggggattgacgcacctaagtacccggcctgcgccacgcaagaaataatgtctggcacaataaactgctgacgttcaatattctgtgcagccagggcgagatgttgtttggcaaacaggactgcctcttgctgagccagctcataattttcagtgcacatagtttactccaggcctgtttgtcgctgaatgagctccactattttattgacggtagcaatctgttctgttttcaactcactcacttccagctcaacctgaaaatttttttctataaacagtatgatttgcacagtaaataacgaatggacaagcccgagagaaaaaatatcgtcatcatcgttcaacgtatgcccacgtaatgagcgtgaaagaaattcccgaatggcggctttcatatcttgctttttcatattcatatccctatctggttaacccagaatcactgctcggcgtacgtctgttgatagcgataaaacccctgccctgatttcacgcccaaataccctgcatcgaccattttctttaataaaaagctggggcgatacttatcatcattaaaactttcatatagcacctgcaacgattgcaaaatcgtatccaagccaatcaaatcggcagtttgtagtggccccatcttgtgcccgaagcaggttttaaacaacgtatcgatatcctcagcacgggcgatctgctcctgcaccataaatatggcttcgttaacaaaaatcatcatggcacgattagtgacaaagcccggagaatcattgaccacgatgccggttttattcaactgagcaaataagtggtgaaatatgttcagtgtacgctctgcagtatgtacaccacggattaattcgacggtgtgcatcagcggtaccgggttcataaaatggacgccgactacattctccggatgtcgcattaattttgacaacgcagtgatagatatggcggacgtattaacaccaaacactgtcgacgcgccgcagatcgtattcatccgtgtgtatagtgcattttttttctctatatcctcagtaatattctcaatcaccaaatcacattctacaatgtcgtccaactcagttgtgaaacggatattttccattatctccgctgtgctatgcgtcttttttttatgctgcgggtgaaaattatataagcgtaagttcgcttcgatcatctgtcggcatttatccaactgagattgagaaatatccacaacgttagttgatatgccgtattgcgccatgttatgagcgacgccagttcccattactcctgcacctattaccgccacgttcatcattgagctcctttactgacaggctatttcgaggttgtcttcgccccccagttgcgccgcgatatgcgcgtagatattgcgcggattggggttttccatcagggtcaaaagatcgatatgtacgttgaaatcgcgttctaaacgggaggtcaattgcgtcaccagcagcgaatgcccgcctaattcaaaaaagtcgtcgtccaccccgaccggcgatatttccagcaacagttccatcagacctgtgatatactgcataccccgcgagtgtgcggctacgaaaggtacgcttaacacgggacgtgcctgataagggtggtgcgtttcgggtcctgcttcgggttgggtctccacactacccattacccgtccaggcaatgggtagtggttgtgtgcgaagggatatgctgatgcgctcccgcgttgcggcagcggagtgccgtaccacacggcccaatccacattgatacctgcacaccacagttgcgccacgtagcgcaatacatcaacgtcttctcttatttccggcggcagcctaacccagttgatactgtgaacgccctcccccagttctcgggtatctgccaacagcgcttcactccaaaaccctctgtcgttacgctgtgcatcggtgatgggatttccttgccaagccagcacgtagccggggataggttcatggcgctcaggaagccagagatgaagcgccttttgctccatttcccacagcaaatgcaacacgtcttgcgtcgcaatcatgccactggctgcagcggcaggcaaaaggcctgttccagcacccgacagcagtgttaatgtcggtagcaggttcatccaggtttttagcgcggcgatagtctggcagcctctgattagcaggctgctgttcgcttgtgccgcccacgtttcagcgtggcaataagcgggtggaatattcatgccgtcgagtaatgccgtcagagcagtcgcttcgcgttgataatgtgccgaatgcgccagccactgtgcgtaagtacaatcgttcgtagtacgtagatctggacagtgtaggccccaaggagcgtcgggcattaggttatccagcgatgccagcatcgcttgcgtaccatcgttttccacttgtatcactcggcggcaatcaaacacggggcgcgccacttgttgtgtgtaggctagcgttgacgcatcaagggtagccagcaacggggtaagctgttgcgtcagctcatccaactgctcgaaagacggcgcggagagagggataaacaccggtgctcgcacttggtcatggtcatcgcgcaccgcaggattcagcccttccaaaatcatatgcacattagtaccgccaatgccaaaagaactgacgccagcgcggggcggcatccgcgatgcgggccactcctgcggctgtatcgggatataaaacggtgaatgcgccagatccagcttcgagttaggcatttgatagttggcgagcggcggaatggtccggtgatgaagtaccagcgccgtcttgattaacccagccacgcccgccgccgcgtgggtgtggccaatattcgcctttacagcccctagtgcacagtattggcggtgtgaagtatcgaacgcctccgtcaacgcagcgaactcgataggatcgccaatacgggtgccggtaccgtgggtttcaacgtagccgatgctttctgggcttacttctgccagatgacaggccgcacaaatgaccgccttctgtccctcatgaccaggcgcgacaaaaccgattttttgtttaccgtcattgttgaccgcgctaccccggatcaccgcatagatgcgatcgcccgctgccagagcatcttccaaacgccgaagcacaaccacacccgcgccatcgccaaacagggtgccagaagcctgactgtcaaaaggacggcagtggccatcggtggagtggatcatgccctgttgacagaagtagcctgacttctgcggtaaatcgatagtaattccacccgccaacgccagatcacattcgccaaacaacaagctgcggcaagcgatatgcgttgcactcagagaagtcgaacaactggtgtagagactatacaccggaccgttgagattgagactgtaggcaatgagatgtgcgagcagatccttatgaccatagatgccagactcaaaacgattcagcgcatcgccgccaatctgtgacagcgaacgccgtagccaatccacatcttctgacgcccccacgaataccccggtgatcagatcgctggtacgttgggcatagcctgcatcttccagcgcatggtaggcaacttcatgtaatacgcgggatttcggatccagagtctgcgcctctttgtgactgtaaccgaaaaatgcagcatcaaagtcgcatatgccctcgatatagggcttggcccgtacataggccgggttgtccagagtactctgttcgacgccttcggccagcaactcctcctcgctaaagaaggtgacgcactctttaccctgaacgatgttatgccagaattcgtgtaacgtccgggactgcgggaaacggaccgccataccaataatggcgatttccatgccgttcatttcgcttgcgtattccataaacttcattacctttcttcagggcgaggaggcgcccggattaatgcaaagacgtgtgactgcgcgcagtatttttcgcaatttgcaaagcacgttttgctatctgattcgcgcgcgtattcgtctgtactgcaggctgtggtgatggcgcatttgactcgccctccgggggctggcaaaacgtcgccagctggcgcacggtggcgtggttgtacagcgacaccacgctcacttgcggatagtgacgcgccatttgcccactcagttgcaccatatcgagtgaggttgcccctaattcggcatagttgtcgtcaatgcctactctatccagacccagatactcttccaggatttggcagagcacgcgttccacttcacgtgtcgcggggctgtaaggcacgccaatttccggacggggccgctttttcactgtctgctgagtaatcgtatcgttagcggcagacggtacaccgcgatccacccggttgccccgcgctaatctatcgatcgcccgaggtgagagcagcagttgcgcccacggactgcgagtgttcagtatcggccacaattggcgcatcacctcggcattgctcatgctgagcgcatagccgccgaggcgcctttctgctatcatggcgttcagccggtccatgcctgccgcagtgcgatgcgttaccaccaccttgccaatatgctgcggcgtggtcagggtggcgaaggcgcgtgcaacctcgggcaatggtacggatttgcatggaaggagcggtagcgtgttatcatctatccaagcgacaatctgttgcaggtagcgactaaacgcaccatgcgccgcgtgaaaattaatcggaataaaggtgccgccttgggcgaagaaacgcatcggtagcgctttgtcttccacaatgtccttgctgcccagctcaagaaaacggcccagcggtgccagcagcgcgaggctagcgtcaagcagacggcctgtgagggagttaaggatcacatccatcccctgtccgtccgatgcggtcagcagagtggcagcgaactgttcgtcgtgtgaatcagctacggcatgtacgcctagcgaaagcaagtaatcgcgtttctgctcgctacctgctgtggcgaaaatctgtgctccgcagcgtttggcaatatgtagcgcagccaagccaacgccccccgccgcactgtggatcaatactcgttctccgggttgcaaattagcgcgcaccaccagtgcgtaataggcggtgaggtatgcgataggcagcgcagccgcctgttcgatgcgacaatgggctggttttctcactacgcaatcgctttctacccgtgcgtactggacaaaaccaccgtttagcaccgccataacatcctctcccggggcaaattcagtgacatttttacccacgcgagtaatgcgtccggcgcactccagtcccaattgcagcggagcctcacccggctgctgccggagcaatcccgtggtgaacagcacatccttaaagttcagtccggtggccagtacctcaatctctacttgtgaatcccccagcgctaagcgcggcgtagggcacaacgctagctttcctgccccctccccctcagcggccagccgcagttggtagttatcggcactgggcacgcgcagtcgcgtgtcgtcatcgacatcttgtatgtggagctgtaccttgcgcttcaccattgccgcacagcgggcaaccatctcgcctgccatgtcgtagagcgtgaaagcgtagctgtcaccctcctcatcgtgccgattgacagtcagcgccacatgtaaggtgttcggcaacgggcggtacaggcgtaaatcctgataaaggaaaggtaccgaatcagtatgaaaaccaggcagttgttcgacaacactgctggcgatgtccaacagcgcagggtgcagtgcgatcgtatcattagcggcaacggtgggcagggccagcgttgcgaaaacctgagtctgggcggtattgccatacagttgttgtacgctgtgccagcgcggcccatagtggaagtgcgtgctcgataattcctttgttggaggagtgatagtgtgcatctcgcgcatcagccccgtgagatcgcacacaacattatcgtctaccatcagacgcgtcgccctgcctctggcatgggttgttaacgtgccactaaagcgctccgtcattgatttcacctcgacactaactccttgcccgttaggtgaaatgtcaacaaaaacgtcaacactgcagttgtccatcacagtcaacggtgccaaaaagaccaattcatcaatgcagatttggtcttgcacaaagtaatggcgcagagcttcatacgccagcgccagatagccggttcccggcagcgtggcgataccggatatccggtgctcatccagcagccaatcggactcgggggataatcgcgcgtagtagctggtgtcagccccttgttgtttataagcctgtagcaacgttcccgtcatcaatgggcgcagtccacgcaagacatcgtattcactgccgtttatagcatccaacaacatgccctgctcacgcaatgcatccaacccgatactgagcgcattcaccttgtagcgggtacgcagttgctgtgccagtgcatccaaataggcgctggcggtagcatagcctgtctggccaatctccgcattcacggcagccaacgagttacagaacagcagtagcagacgctcatccagcagattccgttgcgctaacgcatgcagcacattagcagtaccccgttctttcaccgttagcgtgtcgcgtagcgcagattcgctcaattgatgcagtgtcaatgtggtggtagcgtcggcagcaaaaatcacgccatccaaccgtccatagcgttcgagcagagttgccagacaagctctaaccgcctccgcctgcgtcacgtcgcagtggataacgtctaatgcgtcctgctgcaccgcttcatggtgataacctgtgcggctgctcagtaccacacggactccctcacgctgagcaagcgcttcgccgatcatgcggccaatccccttttcaccgccgataatccacagtacgttgcccggtatacaccctgtttgagggggtaagtgcgccaacagccgtgtcgggataaagcgtcgcaggtaaagcatcccctgcctgagcgccattaccgtttcttgtttcggggccagacgctgggttagcaagttcagattctcatcactgctctgcgcatcgatatcgatcaatcgtacttcggtcgggtgcagctcttgggcaaacacgtttactgcgcccgacaacgctgccagcgtcggttcgggattatcctcttcctgtacgcgaaacgcaccatgggtcaatactgttaaggacgccagcggcgtggtgctgtgcatacaccagcgagcaacacgataaagtcccgagagcgactgtgtcaacgatgatcctgcctccgcaccgggagcatacaagcaatgtaactgtcggtaggttttgtgtgctaaaagtgcgcagatgtcgtggaaatgcgtcagaatacggtcattatcccacacgtcgtcctctgacgatatcggcagcggcattgtgatgctgtcgacaccactactcatcagcgtctgctgtaacttgtcgccgtcagcactaataatgatgatcaattcgcccggcgcatagaacgcctcccgcaaggatgtgtcgtgcatccgccacagcacacgctggagccactcatcttgcggacggcgcagaggatttggatactggcgataaccggaaagtgcagcaccatagcgatagtaataagtctgttcgaaggggtaatccggcaatggaatgtgcttgccgagtgccgtctggttaaagcgtctccaatcaatattctcccccctgacccacagcgccgccagcgtacgatgcaacatgtgctcatcatcgatcgccgcgttggctttgcgtagcgtcaacagggtcggctgatcgctgtattggttatgtccttgaataaaggtagagagcgtattacccggcccacattcgataaacagcgtgggttgtaccaacagttgcgccgcaccttcgctaaacagcaccgcgttgcgcacttgctgcacccagtaatccggcgaggtagcttgctcctcagtaatccatgtaccgcttacattagatataaagcgcttgtgcggcgcgtgcatcgggatttgccccagcaactgtgcaaaatcgtgcagcatcggcgtcatcatggccgagtggaatgcgtgagaggttttcaggcgcctgtgctgtatcccgccctcgactaagcgtgtgctcaaacgggaaatggccgcctgctcgcccgcgactacgcaaaaatgcgcgctattattagctgccagttcaataccccgttctgcagctagccatggggtcaactgttcgcgactaaggtagaccgccatcatgctaccgggacgcatggactgcatcaaacgtccgcgcgcctcaatgacgtgcagcgcatcctcaagagtaaatacgccagcaatacaggccgcaacatactcgcccagactgtgcccgatcatactgtccggcgtaatccccagatcaatcaaggtgcgcgctaggctgtattcgacacagaacaacgccggttgtgtgaactgcgtttgatcaatatcccgcgtatcctcatcgtcaaacaacaacgccttgagatcgaccgtcgaatagcgttggaatgcagcaaagcagcgatccatgtgctggcgaaacatgggttgatgagcatagagcgcgctggccatgccgtgatattggctaccttgaccaggaaacatgaagcagatctccgctgtcgtgcgctgaccattgaagatttccgcttgcaatatcgtggcacaggagagatcgattttcgacccacgactcaccaaataagcccgccgatggtcaaaggctgtgcgtccagtttgcaatgtataagccacatccggcaggcgcacccctactccatgcttgacatattccagtgtggaggccacgcgcaactctaacgcagcgggtgttttagcggagaacaacaacagatagctgtcgcgtacccccgtcgctgaagggtcgtcctcatgttgatgtgcttctagtgcgatgctggcattggtgccgccgatgccgaaggagctcaccagtgcacgacgaggacgcgtcgacggccacggttggacttgctggttaacgtacaatgcagaacgcgatagatctatagcaggattgagttggcgaaagtgcgctgttggtggcaacacttgatgatgcagggcgagcgttgttttgatgacgcccgccactcccgcagcggagttgaggtggccaatattacttttcagcgctgaaaccacacaaaacggaacaggtgttgggccaaacacctcattaagcgcacgtaactcaataggatcacccagcaccgtaccggtgccgtgcgcttccaccaatccgatactgtcgctatcaaaaccggcacggcgcaaactggtgcggattaccgttgattgcccgatcacactcggcgcggtatagccgattttgttattgccatcattattgaccgccgaacctttgatcacaccatagatgcagtcccgatccgccagcgcgtcgtccagacgttttagcagcagcattcctaagccatcaccggtgactgtgccagaggcttggctatcgaaaggacgacagacaccatctcgcgcattgatcatgccttcatgatattcatagccccggtacgcaggcatctcgatagaaacgccgcccgccaatgccgcatcgcaatcccggttacgtagtgcgatgcaggcctggtggatagccactgccgaagtggagcaggcggtgtcaagcgtcacggcagggccggtgaggttaagcgcatgggcaatcaatgctgtgacggaatggatattcaggatactggccttgtacagggcggtagagtcggtagtgtcttgcattaccgcattaagccagtggggggatgtcagcagtccggcataaatgccaatcgcaccagtaaaggtggcaggatcgcacccagcgtgttccagagtttgccagcagcactgatgcaataagcgaatttgcggatccatacattccgcctcgttgggagtataaccaaagaaatccgcatcaaaccattcgtgatcatcaacaatccctttggtttttatataattcgcttgtttaagcgtgtcaggtgtcacaccatgcgcgcgcaactcttcatcactgaacagtgttaatcccgattcccctcctacaaccagcgtccacaacgctgcaatattcgccgcaccggggaaacgtcccgccataccgacaatcgccaccggcatgtcgctgtagacaacagcacgcgttggaattgcatcctccggcgatacggcagtatcgagaaaatgtgctaacgccgtgagcgttgggtacttaaagagatcggtaatatcaatctccaagccaagttgccgcttaatatcccctttaaccctgatggtatccaatgaggtgccaccgagggcgaaaaaggaggcattgctatcaatgtcttgtctatcaagtacgcgttgccagatagcatgcagcgcatgttccatgtcactatgcacctctgatatcgtggtggacacggcgttgcactgagttgcgggcaggagataccgcaactgcgccaagtcggccttgccactatggctttttgcaatctccgtcaccaccaccaaggattccggaatagcgaatggcggcaatctgtcagccaattgccctcgaacttccacctcatcatagctatcattgacgcagaccactgccgcaatatgcagcgtttcacgtacgcggtaaggaaccactaccgcctcgataatgccggagcactccagcaggcgctgctcgatctctccggtttcaattcgttgtccattgatcttaatttgaccgtctttacgcccaaaacagtcaacacagccatcatccagcaaccgggcataatcgccagttttgtacatcataccgccgggaataaaaggatcagggacaaaaaccgtcgcacttagcgccgggttgttctgatagccgatggcgacccccactccacccgccactagttcaccggtggcaccgataggcaacaaatgcccatggagatcggtaatgtagagcgaggtgcccggtaccgcgtatcctatcgggactcgggcgggttgcaacccgttgaaacgatatgcggtggtaaaaatagtgttttccgtcggcccataaccgtttgtcaccaccagatgcgggtatttttgcatcacgtcgttgacatgccacgcagatactgcttcgccgcccaccgtaatgtgttgtaacataccgaagaaatcggcaccttctgccacataggagttaaacaaggatgaggtaaaccaggcgcgcgccacctgttcatcagcgatcgtgcggcgaatgtgattgatatcaagtaatgcctgtttgctgagtaatactagtttgccgtggttgagcaaggtagaccacatctcaaacaccgaaacatcaaactcaaatgggcaggtcagcagcgttgtctcaccgctctccaccttcagcgggctgtcgccttgtatcaggcgcaataaaccgcggtgcgccaccgcgataccttttggcttacccgtcgaccccgatgaataaatcacataagcgcgagaatctggtgtgataaccggaaataccaccgagggcgcgacgggaaatgcacagaggtcactctgcgcaacgtttaatgcatctagcggtttgccatgtaccagcaacagcgccaagccgctgtcatcaataatttcctgcatcctacccactgggtagtcggggctgatgggcacataagcagccccgatcaacatgatggcgatgatggcaaccacggtgtttacccggcgttcgctaattatgcctacagtatcgccaaccataacaccctgctgtaccaaataagccgcgagctgctcagcttgtgctgccaactccgaataggtcaacgcgcacaattcatcaaccactgcgacctgtgctggcgaagtcgcagcaacttgatgaaattgttcgatgacgttggattgactatcccaatcccggcatgccatgcgttccagatagggttgaagtacctgcgcctgctggcatggggacaagtttaccaacgcagcaatggggcgctgcggattgtccaccagttgttcaagcagataactcaggtgcatcagcaacgcttgcgccatgttgttggtcaggtagttaagggcatatgcaatactgaaacggaatcccttctgttgagtgatggtcaaggtcagcggatagtgcgtttgttcatgtacactgagatggcgaattgccacgggcgacgcgcatgacaataatgtcatatcaacgggataattctccaacaccactaaggtattaaaaagatccccagcatgaccttctttatgtaccaaccgttgtatgctggctaaggcatcatgttcattgctgtagtgagctattagtgtttggtgcatacgttgtaagtgttgcaacagtgtcgccccatcatcacgcagacgcagcggcaacgtgttaataaatagccctagtgtttcttctataccatcaattggtatatttcgccctgatattgtcgcgccgaataacacatcgtcagcatagcaccaacgttgtagcaggatgccccaggccacatagaagattactgcgggggtgatacgataatcgctgcatagcgtctgtattttctgacacacatccggagacaaattgatctccacatgatttgtttgattaacgtaagaattgttctcggcttcagtatctgtgtgatattgtgacagcggcacgatacaagttggtgttccctcccgaagatatgcagcccaatagtcgtgctgaaaggtgtgacgtcgggccgacagtgtgtctacaaggggtttcagagatgaggggataatggcgctatcatccctcacaccactgaccacagccgctccatagagttggagcaactgtttaatgaaaagggataagctccagccatccatcacaatatgatggtatgatagtataaaagcactttctttcgttgactgaataaggtaggcccggactgggatcgttttcaaggaaaatgggtattttaaatcagcctgtagcagttgaggaattatagcatcaataccgtcatcctgcgggacaggaatgataatgtcatcattagctagtagaaaacgtatttcctcttgctcacagtctaacacatatatatccggcaacacatcggtcttcaccacctgacaagggcgctcatcaatctcccagttataatcagtgcgaaaacactcatgctttcgaaataacgtttccagcgcccacttgaagtgggcgctatctacatgctgagaaaaaatgcatgtaaaatgctcatggtagttactccttttcttatcctttaaggaatggaataaaaacccctgttgacttggtgttagcggtaactgcttacgcgtgtccatcttattacatggaaaatctccagaggtattatccataaccatcaccttattatcggatttatagattatttaacatgattattctaaatggcacacctatccgcaagtatagttttttattgcgtattcatataatcatattgcattttatcacttacaggaatacccccaaaaaatccttatattctgattacatgtttttcttcaatgaattagattctgtctgtaagcaaaaacatgtaagtcatgcagtacatacatgatgtagcgggtatgaattgatacagccaccacatagaaaataatgcgtaattcccatttacataaaaaccgttgtatcgtaaattcctcttaaatactgccaaaacaacagatacacagatacacagatacacagatacacagatacacagatacacagatacacagatacacagatacacagatacacagatacacagatacacagataccattcaggatggggggaaacatggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatctaaatgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattgaatcgccacggataatctagacacttctgagccgtcgataatattgattttcatattccgtcggtggtgtaagtatcccgcataatcgtgccattcacatttagagatcatccggcataatcaatctgccaacgaaggagagcgctatgcgtaaagcccgttttactgagcatcagatcatcgccgtgattaagtcggttgaagccggacgaactgttaaagatgtctgtcgcgaggccggaatctctgaagccacctattacaactggaagtccaaatacggcggcatggaggcttctgatattaagaaaatcaaggatcttgaggacgagaaccgccgtctaaaacaaatgtttgccgacctgagtctggagaaccgggcgctgaaagacgttatcgaaaaaaagctttaaaaccagcctttaagcgtgagctggttactcatctgataacgacgttcgaactcagtatccgtcaggcctgccggagtctgaacctgagctggtctgtcgattttatgcatgatgccctggtctgtggccgtcgttttcgcatgttcaatgtcgttgatgattttaaccgtgaggcattgtcgattgaaatcgatctgaatctgccagctcagcgagtggtccgtgtactcgacaggatcgcggcaaaccgtggctatccggccatgcttcgtctggataacggcccggaatttatctccctggcactggctgaatgggcagagaaacatgcaataaaactggagtttatccagccgggtaagccgacgcagaacgctttcattgagcgctttaaccggacataccgaacagaaatactcgatttttatctgttcagaacgctgaatgaagtacgggaaatcactgaaaaatggttatcaaaatataactgtgaacgcccgcatgaatcgctgaataatatgacaccggaggaataccgacagcgccattatttggccgggatctcaaaaagtgtatggaactaaaatgggtctatttacactgctgctacgataatgcctgcgtggaaagcttctttcattcactgaaagtggaatgtctccatggagaacactttatcagccgggaaataatgcgggcaacggtgtttaattatatcgaatgtgattacagtcgctggcgacggcacagttggtgtggcggtctcactctggaacaatttgaaaaccagaacctcgcttagagcagtgtccatattacgagggtaggatcagtcgtttctttcgcggtaactttatatgatcgctgtgtaccagcatcgagagaagaaattcaggatgtattcaacactgagttcacaagctctgtagctattaagtcagtattatttacgtttacgatacatgttattatcgcaggatctttatcttggtagtgatactgcgagtggatacacccccactcagtatcttctataactatggcttttggttcttcaggcatcataccttccataacacgttcttgatggatacgtaacttgtagtacttctctggagatgaagaaatttcaacgagtacagattgtagatgtacgaagcctagaaatttaaaacactcggattttgtagaggattttaatgataaagtccagataacaaacacgttattggaaccatcaccataatttttagtgtcaatcttatctaccagctcctcgttgattaacatagactgatttagcaacttccgcttcacgccctgagcggactgttatcgctctttagacacagttccactaggggagaggatcagcgcttcccacgtagggacactatagtaactatcaccacatgcagtagggaagctcaaaccaaatttatgtagccagctcctattggtggtcattctggtggtcttgacaggaagataactctggtttagcttacttattagccacttactggcaaaggcgatcccagtcagaggagccaaattcaaaaaagcctgctttcgagcaggctttttactttctaattaccaacgctcttaaaacatctgtcttgaaccagaactaatttgcacaggcattcccgatcgatgttgcaacgcagcatttgcgcgatttacatcaacttcttgcccgttgataaacgcccgcaaagatggggttaccggcaatggcacttttcggtcagactcatattctgcacgattgcgcgacagcggctcatgaacttccagccactttgaaccatccggttccgttgtgtatttcactggctgatcaataatttgtacacgagtgcctacaggaacattatcaaacagatatttgatatcgtcattacgcagacgaatacagccctgacttacacggag

The invention claimed is:

1. A method of treating colorectal cancer in a mammal, including man, comprising administering to a patient in need thereof cells containing in their genome a DNA molecule comprising a combination of nucleotide sequences, the combination comprising:

a nucleotide sequence selected from the group consisting of: the nucleotide sequence SEQ ID NO: 5 (ORF 3) coding for the protein of sequence SEQ ID NO: 6, the nucleotide sequence SEQ ID NO: 7 (ORF 3a) coding for the protein of sequence SEQ ID NO: 8, the nucleotide sequence SEQ ID NO: 9 (ORF 3b) coding for the protein of sequence SEQ ID NO: 10, and a nucleotide sequence derived from SEQ ID NO: 5, 7, or 9 and coding for the protein of sequence SEQ ID NO: 6, 8, or 10, respectively, or coding for a derived protein having a thioesterase activity, a nucleotide sequence selected from the group consisting of: the nucleotide sequence SEQ ID NO: 11 (ORF 4) coding for the protein of sequence SEQ ID NO: 12, the nucleotide sequence SEQ ID NO: 13 (ORF 4a) coding for the protein of sequence SEQ ID NO: 14, the nucleotide sequence SEQ ID NO: 15 (ORF 4b) coding for the protein of sequence SEQ ID NO: 16, the nucleotide sequence SEQ ID NO: 17 (ORF 4c) coding for the protein of sequence SEQ ID NO: 18, and a nucleotide sequence derived from SEQ ID NO: 11, 13, 15, or 17 and coding for the protein of sequence SEQ ID NO: 12, 14, 16, or 18, respectively, or coding for a derived protein having a β lactamase activity, a nucleotide sequence selected from the group consisting of: the nucleotide sequence SEQ ID NO: 19 (ORF 5) coding for the protein of sequence SEQ ID NO: 20, the nucleotide sequence SEQ ID NO: 21 (ORF 5a) coding for the protein of sequence SEQ ID NO: 22, the nucleotide sequence SEQ ID NO: 23 (ORF 5b) coding for the protein of sequence SEQ ID NO: 24, the nucleotide sequence SEQ ID NO: 25 (ORF 5c) coding for the protein of sequence SEQ ID NO: 26, and a nucleotide sequence derived from SEQ ID NO: 19, 21, 23, or 25 and coding for the protein of sequence SEQ ID NO: 20, 22, 24, or 26, respectively, or coding for a derived protein having a polyketide synthase activity, a nucleotide sequence selected from the group consisting of: the nucleotide sequence SEQ ID NO: 27 (ORF 6) coding for the protein of sequence SEQ ID NO: 28, the nucleotide sequence SEQ ID NO: 29 (ORF 6a) coding for the protein of sequence SEQ ID NO: 30, the nucleotide sequence SEQ ID NO: 31 (ORF 6b) coding for the protein of sequence SEQ ID NO: 32, the nucleotide sequence SEQ ID NO: 33 (ORF 6c) coding for the protein of sequence SEQ ID NO: 34, the nucleotide sequence SEQ ID NO: 35 (ORF 6d) coding for the protein of sequence SEQ ID NO: 36, the nucleotide sequence SEQ ID NO: 37 (ORF 6e) coding for the protein of sequence SEQ ID NO: 38, and a nucleotide sequence derived from SEQ ID NO: 27, 29, 31, 33, 35, or 37 and coding for the protein of sequence SEQ ID NO: 28, 30, 32, 34, 36, or 38, respectively, or coding for a derived protein having a non ribosomal peptide synthetase activity, a nucleotide sequence selected from the group consisting of: the nucleotide sequence SEQ ID NO: 47 (ORF 8) coding for the protein of sequence SEQ ID NO: 48, the nucleotide sequence SEQ ID NO: 49 (ORF 8a) coding for the protein of sequence SEQ ID NO: 50, the nucleotide sequence SEQ ID NO: 51 (ORF 8b) coding for the protein of sequence SEQ ID NO: 52, the nucleotide sequence SEQ ID NO: 53 (ORF 8c) coding for the protein of sequence SEQ ID NO: 54, and a nucleotide sequence derived from SEQ ID NO: 47, 49, 51, or 53 and coding for a protein of sequence SEQ ID NO: 48, 50, 52, or 54, respectively, or coding for a derived protein having an amidase activity, a nucleotide sequence selected from the group consisting of: the nucleotide sequence SEQ ID NO: 55 (ORF 9) coding for the protein of sequence SEQ ID NO: 56, the nucleotide sequence SEQ ID NO: 57 (ORF 9a) coding for the protein of sequence SEQ ID NO: 58, the nucleotide sequence SEQ ID NO: 59 (ORF 9b) coding for the protein of sequence SEQ ID NO: 60, the nucleotide sequence SEQ ID NO: 61 (ORF 9c) coding for the protein of sequence SEQ ID NO: 62, and a nucleotide sequence derived from SEQ ID NO: 55, 57, 59, or 61 and coding for the protein of sequence SEQ ID NO: 56, 58, 60, or 62, respectively, or coding for a derived protein having a non ribosomal peptide synthetase and polyketide synthase activity, a nucleotide sequence selected from the group consisting of: the nucleotide sequence SEQ ID NO: 63 (ORF 10) coding for the protein of sequence SEQ ID NO: 64, the nucleotide sequence SEQ ID NO: 65 (ORF 10a) coding for the protein of sequence SEQ ID NO: 66, the nucleotide sequence SEQ ID NO: 67 (ORF 10b) coding for the protein of sequence SEQ ID NO: 68, the nucleotide sequence SEQ ID NO: 69 (ORF 10c) coding for the protein of sequence SEQ ID NO: 70, and a nucleotide sequence derived from SEQ ID NO: 63, 65, 67, or 69 and coding for the protein of sequence SEQ ID NO: 64, 66, 68, or 70, respectively, or coding for a derived protein having a non ribosomal peptide synthetase activity, a nucleotide sequence selected from the group consisting of: the nucleotide sequence SEQ ID NO: 71 (ORF 11) coding for the protein of sequence SEQ ID NO: 72, the nucleotide sequence SEQ ID NO: 73 (ORF 11a) coding for the protein of sequence SEQ ID NO: 74, the nucleotide sequence SEQ ID NO: 75 (ORF 11b) coding for the protein of sequence SEQ ID NO: 76, the nucleotide sequence SEQ ID NO: 77 (ORF 11c) coding for the protein of sequence SEQ ID NO: 78, and a nucleotide sequence derived from SEQ ID NO: 71, 73, 75, or 77 and coding for the protein of sequence SEQ ID NO: 72, 74, 76, or 78, respectively, or coding for a derived protein having a polyketide synthase activity, a nucleotide sequence selected from the group consisting of: the nucleotide sequence SEQ ID NO: 79 (ORF 12) coding for the protein of sequence SEQ ID NO: 80, the nucleotide sequence SEQ ID NO: 81 (ORF 12a) coding for the protein of sequence SEQ ID NO: 82, the nucleotide sequence SEQ ID NO: 83 (ORF 12b) coding for the protein of sequence SEQ ID NO: 84, the nucleotide sequence SEQ ID NO: 85 (ORF 12c) coding for the protein of sequence SEQ ID NO: 86, and a nucleotide sequence derived from SEQ ID NO: 79, 81, 83, or 85 and coding for the protein of sequence SEQ ID NO: 80, 82, 84, or 86, respectively, or coding for a derived protein having a non ribosomal peptide synthetase activity, a nucleotide sequence selected from the group consisting of: the nucleotide sequence SEQ ID NO: 87 (ORF 13) coding for the protein of sequence SEQ ID NO: 88, the nucleotide sequence SEQ ID NO: 89 (ORF 13a) coding for the protein of sequence SEQ ID NO: 90, the nucleotide sequence SEQ ID NO: 91 (ORF 13b) coding for the protein of sequence SEQ ID NO: 92, the nucleotide sequence SEQ ID NO: 93 (ORF 13c) coding for the protein of sequence SEQ ID NO: 94, and a nucleotide sequence derived from SEQ ID NO: 87, 89, 91, or 93 and coding for the protein of sequence SEQ ID NO: 88, 90, 92, or 94, respectively, or coding for a derived protein having a malonyl-CoA-transacylase activity, a nucleotide sequence selected from the group consisting of: the nucleotide sequence SEQ ID NO: 95 (ORF 14) coding for the protein of sequence SEQ ID NO: 96, the nucleotide sequence SEQ ID NO: 97 (ORF 14a) coding for the protein of sequence SEQ ID NO: 98, the nucleotide sequence SEQ ID NO: 99 (ORF 14b) coding for the protein of sequence SEQ ID NO: 100, the nucleotide sequence SEQ ID NO: 101 (ORF 14c) coding for the protein of sequence SEQ ID NO: 102, and a nucleotide sequence derived from SEQ ID NO: 95, 97, 99, or 101 and coding for the protein of sequence SEQ ID NO: 96, 98, 100, or 102, respectively, or coding for a derived protein having an acyl-CoA-dehydrogenase activity, a nucleotide sequence selected from the group consisting of: the nucleotide sequence SEQ ID NO: 103 (ORF 15) coding for the protein of sequence SEQ ID NO: 104, the nucleotide sequence SEQ ID NO: 105 (ORF 15a) coding for the protein of sequence SEQ ID NO: 106, the nucleotide sequence SEQ ID NO: 107 (ORF 15b) coding for the protein of sequence SEQ ID NO: 108, the nucleotide sequence SEQ ID NO: 109 (ORF 15c) coding for the protein of sequence SEQ ID NO: 110, and a nucleotide sequence derived from SEQ ID NO: 103, 105, 107, or 109 and coding for the protein of sequence SEQ ID NO: 104, 106, 108, or 110, respectively, or coding for a derived protein having a D-alanyl carrier protein activity, a nucleotide sequence selected from the group consisting of: the nucleotide sequence SEQ ID NO: 111 (ORF 16) coding for the protein of sequence SEQ ID NO: 112, the nucleotide sequence SEQ ID NO: 113 (ORF 16a) coding for the protein of sequence SEQ ID NO: 114, the nucleotide sequence SEQ ID NO: 115 (ORF 16b) coding for the protein of sequence SEQ ID NO: 116, the nucleotide sequence SEQ ID NO: 117 (ORF 16c) coding for the protein of sequence SEQ ID NO: 118, and a nucleotide sequence derived from SEQ ID NO: 111, 113, 115, or 117 and coding for the protein of sequence SEQ ID NO: 112, 114, 116, or 118, respectively, or coding for a derived protein having a 3-hydroxyacyl-CoA-dehydrogenase activity, a nucleotide sequence selected from the group consisting of: the nucleotide sequence SEQ ID NO: 119 (ORF 17) coding for the protein of sequence SEQ ID NO: 120, the nucleotide sequence SEQ ID NO: 121 (ORF 17a) coding for the protein of sequence SEQ ID NO: 122, the nucleotide sequence SEQ ID NO: 123 (ORF 17b) coding for the protein of sequence SEQ ID NO: 124, the nucleotide sequence SEQ ID NO: 125 (ORF 17c) coding for the protein of sequence SEQ ID NO: 126, and a nucleotide sequence derived from SEQ ID NO: 119, 121, 123, or 125 and coding for the protein of sequence SEQ ID NO: 120, 122, 124, or 126, respectively, or coding for a derived protein having a polyketide synthase activity, a nucleotide sequence selected from the group consisting of: the nucleotide sequence SEQ ID NO: 127 (ORF 18) coding for the protein of sequence SEQ ID NO: 128, the nucleotide sequence SEQ ID NO: 129 (ORF 18a) coding for the protein of sequence SEQ ID NO: 130, the nucleotide sequence SEQ ID NO: 131 (ORF 18b) coding for the protein of sequence SEQ ID NO: 132, the nucleotide sequence SEQ ID NO: 133 (ORF 18c) coding for the protein of sequence SEQ ID NO: 134, the nucleotide sequence SEQ ID NO: 135 (ORF 18d) coding for the protein of sequence SEQ ID NO: 136, the nucleotide sequence SEQ ID NO: 137 (ORF 18e) coding for the protein of sequence SEQ ID NO: 138, and a nucleotide sequence derived from SEQ ID NO: 127, 129, 131, 133, 135, or 137 and coding for the protein of sequence SEQ ID NO: 128, 130, 132, 134, 136, or 138, respectively, or coding for a derived protein having a non ribosomal peptide synthetase and polyketide synthase activity, and a nucleotide sequence selected from the group consisting of: the nucleotide sequence SEQ ID NO: 145 (ORF 20) coding for the protein of sequence SEQ ID NO: 146, the nucleotide sequence SEQ ID NO: 147 (ORF 20a) coding for the protein of sequence SEQ ID NO: 148, the nucleotide sequence SEQ ID NO: 149 (ORF 20b) coding for the protein of sequence SEQ ID NO: 150, a nucleotide sequence derived from SEQ ID NO: 145, 147, or 149 and coding for the protein of sequence SEQ ID NO: 146, 148, or 150, respectively, or coding for a derived protein having a 4-phosphopantetheinyl transferase activity.

2. The method according to claim 1, wherein the cells contain in their genome a DNA molecule comprising the combination of:

SEQ ID NO: 145, 147, or 149, located in the 5'→3' sense direction on the 5'-3' DNA strand, and SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, SEQ ID NO: 127, 129, 131, 133, 135, or 137, located in the 5'→3' sense direction on the 3'-5' DNA strand.

3. The method according to claim 1, wherein the cells contain in their genome a DNA molecule comprising the combination of:

SEQ ID NO: 1, SEQ ID NO: 139, 141, or 143, SEQ ID NO: 145, 147, or 149, SEQ ID NO: 151, 153, or 155, SEQ ID NO: 157, 159, or 161, and SEQ ID NO: 163, 165, and 167, located in the 5'→3' sense direction on the 5'-3' DNA strand, and SEQ ID NO: 3, SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, SEQ ID NO: 127, 129, 131, 133, 135, or 137, located in the 5'→3' sense direction on the 3'-5' DNA strand, or its complementary sequence, said DNA molecule coding for a combination of proteins, the combination comprising: the protein SEQ ID NO: 2, the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 130, 142, or 144, the protein SEQ ID NO: 146, 148, or 150, the protein SEQ ID NO: 152, 154, or 156, the protein SEQ ID NO: 158, 160, or 162, and the protein SEQ ID NO: 164, 166, and 168.

4. The method according to claim 1, wherein the cells contain in their genome a DNA molecule comprising the combination of:

SEQ ID NO: 145, 147, or 149, and SEQ ID NO: 139, 141, or 143, located in the 5'→3' sense direction on the 5'→3' DNA strand, SEQ ID NO: 3, SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 39, 41, 43, or 45, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'-3' sense direction on the 3'-5' DNA strand, or its complementary sequence, said DNA molecule coding for the protein SEQ ID NO: 4, the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 40, 42, 44, or 46, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, the protein SEQ ID NO: 140, 142, or 144, and the protein SEQ ID NO: 146, 148, or 150.

5. The method according to claim 1, wherein the cells contain in their genome a DNA molecule comprising the combination of:

SEQ ID NO: 145, 147, or 149, located in the 5'→3' sense direction on the 5'-3' DNA strand, SEQ ID NO: 5, 7, or 9, SEQ ID NO: 11, 13, 15, or 17, SEQ ID NO: 19, 21, 23, or 25, SEQ ID NO: 27, 29, 31, 33, 35, or 37, SEQ ID NO: 47, 49, 51, or 53, SEQ ID NO: 55, 57, 59, or 61, SEQ ID NO: 63, 65, 67, or 69, SEQ ID NO: 71, 73, 75, or 77, SEQ ID NO: 79, 81, 83, or 85, SEQ ID NO: 87, 89, 91, or 93, SEQ ID NO: 95, 97, 99, or 101, SEQ ID NO: 103, 105, 107, or 109, SEQ ID NO: 111, 113, 115, or 117, SEQ ID NO: 119, 121, 123, or 125, and SEQ ID NO: 127, 129, 131, 133, 135, or 137, located in the 5'→3' direction sense on the 3'-5' DNA strand, or its complementary sequence, said DNA molecule coding for the protein SEQ ID NO: 6, 8, or 10, the protein SEQ ID NO: 12, 14, 16, or 18, the protein SEQ ID NO: 20, 22, 24, or 26, the protein SEQ ID NO: 28, 30, 32, 34, 36, or 38, the protein SEQ ID NO: 48, 50, 52, or 54, the protein SEQ ID NO: 56, 58, 60, or 62, the protein SEQ ID NO: 64, 66, 68, or 70, the protein SEQ ID NO: 72, 74, 76, or 78, the protein SEQ ID NO: 80, 82, 84, or 86, the protein SEQ ID NO: 88, 90, 92, or 94, the protein SEQ ID NO: 96, 98, 100, or 102, the protein SEQ ID NO: 104, 106, 108, or 110, the protein SEQ ID NO: 112, 114, 116, or 118, the protein SEQ ID NO: 120, 122, 124, or 126, the protein SEQ ID NO: 128, 130, 132, 134, 136, or 138, and the protein SEQ ID NO: 146, 148, or 150.

6. The method according to claim 1, wherein the cells contain the DNA molecule in the native state.

7. The method according to claim 6, wherein the cells are bacterial cells or fungal cells.

8. The method according to claim 6, wherein the cells are selected from the group consisting of: *Escherichia* bacteria, *E. coli*, *Salmonella* bacteria, *S. typhimurium*, *S. typhi*, *Lactobacilli* bacteria, *Streptomyces* bacteria, and yeast cells.

9. The method according to claim 1, the cells being transformed with said DNA molecule.

10. The method according to claim 9, wherein the cells are bacterial cells or fungal cells.

11. The method according to claim 9, wherein the cells are selected from the group consisting of: *Escherichia* bacteria, *E. coli*, *Salmonella* bacteria, *S. typhimurium*, *S. typhi*, *Lactobacilli* bacteria, *Streptomyces* bacteria, and yeast cells.

12. The method according to claim 1, wherein the combination of nucleotide sequences further comprises the nucleotide sequence SEQ ID NO: 1 (ORF 1) coding for the protein of sequence SEQ ID NO: 2, or a nucleotide sequence derived from SEQ ID NO: 1 and coding for the protein of sequence SEQ ID NO: 2 or coding for a derived protein having a P4-like bacteriophage integrase activity.

13. The method according to claim 1, wherein the combination of nucleotide sequences further comprises the nucleotide sequence SEQ ID NO: 3 (ORF 2) coding for the protein of sequence SEQ ID NO: 4, or a nucleotide sequence derived from SEQ ID NO: 3 and coding for the protein of sequence SEQ ID NO: 4.

14. The method according to claim 1, wherein the combination of nucleotide sequences further comprises a nucleotide sequence selected from the group consisting of:
   the nucleotide sequence SEQ ID NO: 39 (ORF 7) coding for the protein of sequence SEQ ID NO: 40;
   the nucleotide sequence SEQ ID NO: 41 (ORF 7a) coding for the protein of sequence SEQ ID NO: 42;
   the nucleotide sequence SEQ ID NO: 43 (ORF 7b) coding for the protein of sequence SEQ ID NO: 44;
   the nucleotide sequence SEQ ID NO: 45 (ORF 7c) coding for the protein of sequence SEQ ID NO: 46; and
   a nucleotide sequence derived from SEQ ID NO: 39, 41, 43 or 45 and coding for the protein of sequence SEQ ID NO: 40, 42, 44 or 46, respectively, or coding for a derived protein having a MATE-like efflux pomp activity.

15. The method according to claim 1, wherein the combination of nucleotide sequences further comprises a nucleotide sequence selected from the group consisting of:
   the nucleotide sequence SEQ ID NO: 139 (ORF 19) coding for the protein of sequence SEQ ID NO: 140;
   the nucleotide sequence SEQ ID NO: 141 (ORF 19a) coding for the protein of sequence SEQ ID NO: 142;
   the nucleotide sequence SEQ ID NO: 143 (ORF 19b) coding for the protein of sequence SEQ ID NO: 144; and
   a nucleotide sequence derived from SEQ ID NO: 139, 141 or 143 and coding for the protein of sequence SEQ ID NO: 140, 142, or 144, respectively, or coding for a derived protein having a LuxR-like regulator activity.

16. The method according to claim 1, wherein the combination of nucleotide sequences further comprises a nucleotide sequence selected from the group consisting of:
   the nucleotide sequence SEQ ID NO: 151 (ORF 21) coding for the protein of sequence SEQ ID NO: 152,
   the nucleotide sequence SEQ ID NO: 153 (ORF 21a) coding for the protein of sequence SEQ ID NO: 154,
   the nucleotide sequence SEQ ID NO: 155 (ORF 21b) coding for the protein of sequence SEQ ID NO: 156, and
   a nucleotide sequence derived from SEQ ID NO: 151, 153, or 155 and coding for the protein of sequence SEQ ID NO: 152, 154, or 156, respectively, or coding for a derived protein having a transposase subunit A activity.

17. The method according to claim 1, wherein the combination of nucleotide sequences further comprises a nucleotide sequence selected from the group consisting of:
   the nucleotide sequence SEQ ID NO: 157 (ORF 22) coding for the protein of sequence SEQ ID NO: 158;
   the nucleotide sequence SEQ ID NO: 159 (ORF 22a) coding for the protein of sequence SEQ ID NO: 160;
   the nucleotide sequence SEQ ID NO: 161 (ORF 22b) coding for the protein of sequence SEQ ID NO: 162; and
   a nucleotide sequence derived from SEQ ID NO: 157, 159 or 161 and coding for the protein of sequence SEQ ID NO: 158, 160 or 162, respectively, or for a derived protein having a transposase subunit B activity.

18. The method according to claim 1, wherein the combination of nucleotide sequences further comprises a nucleotide sequence selected from the group consisting of:
   the nucleotide sequence SEQ ID NO: 163 (ORF 23) coding for the protein of sequence SEQ ID NO: 164;
   the nucleotide sequence SEQ ID NO: 165 (ORF 23a) coding for the protein of sequence SEQ ID NO: 166;
   the nucleotide sequence SEQ ID NO: 167 (ORF 23b) coding for the protein of sequence SEQ ID NO: 168; and
   a nucleotide sequence derived from SEQ ID NO: 163, 165 or 167, and coding for the protein of sequence SEQ ID NO: 164, 166 or 168, respectively, or coding for a derived protein having a transposase activity.

19. The method according to claim 1, wherein the DNA molecule comprises the nucleotide sequence SEQ ID NO: 170, or its complementary sequence.

20. The method according to claim 1, wherein the DNA molecule comprises the nucleotide sequence SEQ ID NO: 171, or its complementary sequence.

21. The method according to claim 1, wherein the DNA molecule comprises the nucleotide sequence SEQ ID NO: 169, or its complementary sequence.

22. The method according to claim 2, wherein the combination of nucleotide sequences further comprises at least one sequence selected from the group consisting of:
   SEQ ID NO: 1;
   SEQ ID NO: 139, 141 or 143;
   SEQ ID NO: 151, 153 or 155;
   SEQ ID NO: 157, 159 or 161; and
   SEQ ID NO: 163, 165 or 167, located in the 5'→3' sense direction on the 5'-3' DNA strand.

23. The method according to claim 2, wherein the combination of nucleotide sequences further comprises at least one sequence selected from the group consisting of:
   SEQ ID NO: 3; and
   SEQ ID NO: 39, 41, 43 or 45, located in the 5'→3' sense direction on the 3'-5' DNA strand.

24. The method according to claim 1, wherein the cells are not *E. coli* strain Nissle 1917, deposited at the DSM under the number 6601.

* * * * *